United States Patent 7,608,413 (KIDNEY DISEASE TARGETS AND USES THEREOF) - sequence listing, part 3

SEQ ID NO: 4416 - DNA, 3114 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttata

SEQ ID NO: 4417 - DNA, 2117 bp, Homo sapiens; identical to SEQ ID NO: 3113

SEQ ID NO: 4418 - DNA, 2117 bp, Homo sapiens; identical to SEQ ID NO: 3113

SEQ ID NO: 4419 - DNA, 5313 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 4420 - DNA, 5484 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 4421 - DNA, 1133 bp, Homo sapiens
cgaactgatttgtccctctctgctctccgtctgaaaaccttggccgaaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcactt

SEQ ID NO: 4422 - DNA, 958 bp, Homo sapiens
aaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgaaaaaaaaaaaaaaaaaaaaaaaaaaaaaaaaaaaaaaaaaaaaaaaa

SEQ ID NO: 4423 - DNA, 3384 bp, Homo sapiens
ggcgccgtacgtgcgcgcgcgcggcggcccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatgctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaaggcgaactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaatatcctggattccttaacgcacgcacacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatccttgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgctgctccccgaggcaccgcttccctgtgcggcgctgcagaggggccctcagtgtggcactcctcgtcaaagaaaaataaaggctagaactgc

SEQ ID NO: 4424 - DNA, 3275 bp, Homo sapiens
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggcttgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaaaaaaaaaaaaaaaaaaaa

SEQ ID NO: 4425 - DNA, 3953 bp, Homo sapiens
gggttcttacccatttaaagtttgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatcaagatgtcccaggtcctgggaagtttactcaataaagctggctttcccctgccctc

SEQ ID NO: 4426 - DNA, 4277 bp, Homo sapiens
ctcaggcccagacttgggtgttacaggaacagtgtggcctctctggaactctgcagaccaattccctccctagatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcacag

SEQ ID NO: 4427 - DNA, 4277 bp, Homo sapiens; identical to SEQ ID NO: 4426

SEQ ID NO: 4428 - DNA, 4277 bp, Homo sapiens; identical to SEQ ID NO: 4426

SEQ ID NO: 4429 - DNA, 4277 bp, Homo sapiens; identical to SEQ ID NO: 4426

SEQ ID NO: 4430 - DNA, 4041 bp, Homo sapiens
agttctggaaagtcattgacaggggattaacctagaacatcaattataaacaggcagcaggcctcaggcccagacttgggtgttacaggaacagtgtggcctctctggaactctgcagaccacctgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtgtctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccggttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 4431 - DNA, 4277 bp, Homo sapiens; identical to SEQ ID NO: 4426

SEQ ID NO: 4432 - DNA, 1089 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4433 - DNA, 3385 bp, Homo sapiens
tggtgtaggagaagagggatcaggacgaagtcccaggccccgggcggggctctcagggtctcaggctccgagggccgcgtctgcaatggggaggcgcagcgttggggattccccactcccacgagtttcacttcttctcccaacctatgtcgggtccttcttccaggatactcgtgacgcgtccccatttcccactcccattgggtgtcgggtgtctagagaagccaatcagcgtcgccgtggtcccagttctaaagtccccacgcacccacccggactcagaatctcctcagacgccgagatgcgggtcacggcaccccgaaccgtcctcctgctgctctcggcggccctggccctgaccgagacctgggccggtgagtgcgggtcggcagggaaatggcctctgtggggaggagcgaggggaccgcaggcgggggcgcaggacccggggagccgcgccgggaggagggtcgggcgggtctcagcccctcctcgcccccaggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccggtgagtgaccccggcccggggcgcaggtcacgactccccatcccccacgtacggcccgggtcgccccgagtctccgggtccgagatccgcccccctgaggccgcgggacccgcccagaccctcgaccggcgagagccccaggcgcgtttacccggtttcattttcagttgaggccaaaatccccgcgggttggtcggggcggggcggggcggggctcgggggacggggctgaccgcggggcctgggccagggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgggtaccaggggcagtggggagccttccccatctcctataggtcgccggggatggcctcccacgagaagaggaggaaaatgggatcagcgctagaatgtcgccctcccttgaatggagaatggcatgagttttcctgagtttcctctgagggccccctcttctctctaggacaataaggaatgacgtctctgaggaaatggaggggaagacagtccctagaatactgatcaggggtcccctttgacccctgcagcagccttgggaaccgtgactttcctctcaggccttgttctctgcctcacactcagtgtgtttggggctctgattccagcacttctgagtcactttacctccactcagatcgggagcagaagtccctgttccccgctcagagactcgaactttccaatgaataggagattatcccaggtgcctgcgtccaggctggtgtctgggttctgtgccccttccccaccccaggtgtcctgtccattctcaggctggtcacatgggtggtcctagggtgtcccatgagagatgcaaagcgcctgaattttctgactcttcccatcagaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctgttctcagggaaagcaggagcccttctggagcccttcagcagggtcagggcccctcatcttcccctcctttcccagagccatcttcccagtccaccatccccatcgtgggcattgttgctggcctggctgtcctagcagttgtggtcatcggagctgtggtcgctactgtgatgtgtaggaggaagagctcaggtagggaaggggtgaggggtggggtctgggttttcttgtcccactgggggtttcaagccccaggtagaagtgttccctgcctcattactgggaagcagcatccacacaggggctaacgcagcctgggaccctgtgtgccagcacttactcttttgtgcagcacatgtgacaatgaaggacggatgtatcgccttgatggttgtggtgttggggtcctgattccagcattcatgagtcaggggaaggtccctgctaaggacagaccttaggagggcagttggtccaggacccacacttgctttcctcgtgtttcctgatcctgccttgggtctgtagtcatacttctggaaattccttttggttccaagacgaggaggttcctctaagatctcatggccctgcttcctcccagtcccctcacaggacattttcttcccacaggtggaaaaggagggagctactctcaggctgcgtgtaagtggtgggggtgggagtgtggaggagctcacccaccccataattcctcctgtcccacgtctcctgagggctctgaccaggtcctgtttttgttctactccagccagcgacagtgcccagggctctgatgtgtctctcacagcttgaaaaggtgagattcttggggtctagagtgggtggggtggcgggtctgggggtgggtggggcagtggggaaaggcctgggtaatggagattctttgattgggatgtttcgcgtgtgtggtgggctgttcagagtgtcatcacttaccatgactaaccagaatttgttcatgactgttgttttctgtagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcgcatgctgacctgtgtttcctcccca

SEQ ID NO: 4434 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4435 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagcggagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4436 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccgtccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4437 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4438 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 4439 - DNA, 1098 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaagcctgag

SEQ ID NO: 4440 - DNA, 3950 bp, Homo sapiens
aatcattcagggattaccaatattgtgctacctactgtatcaataaacaaaaaggaaactggtctctatgagaatctctgtgtggtggcttcagacaaaacttcgccaggtttagagagaaaacccctgtctctacacctccattcccagggcgagctcactctctggcatcaagttctccgtgatcagtttccctacacaagatccaagaggagaggtaaggagtgagaggcagggagtccagttcagggacagggattccaggaggagaagtgaaggggaagcgggtcgggcagcctgggggtctctccctggtttccacagacagatccttgtgcaggactcaggcagacagtgtgacaaagaggctggtgtaggagaagagggatcaggacgaagtcccagccgcgggcggggctctcagggtctcaggctccgagagccttgtctgcattggggaggcgcagcgttggggattccccactcccacgagtttcacttcttctcccaacctatgtcgggtccttcttccaggatactcgtgacgcgtccccatttcccactccattgggtgtcggatatctagagaagccaatcagtgtcgccggggtcccagttctaaagtccccacgcacccacccggactcagaatctcctcagacgccgagatgcgggtcacggcgccccgaaccgtcctcctgctgctctggggggcagtggccctgaccgagacctgggccggtgagtgcggggtcgggagggaaatggcctctgtggggaggagcgaggggaccgcaggcgggggcgcaggacctgaggagccgcgccgggaggagggtcgggcgggtctcagcccctcctcgcccccaggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccggtgagtgaccccggcccggggcgcaggtcacgactccccatcccccacgtacggcccggggtcgccccgagtctccgggtccgagatccgcctccctgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtatggctgcgacctggggcccgacgggcgcttcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgggtaccaggggcagtggggagccttccccatctcctataggtcgccggggatggcctcccacgagaagaggaggaaaatgggatcagcgctagaatgtcgccctcccttgaatggagaatggcatgagttttcctgagtttcctctgagggccccctcttctctctaggacaattaagggatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccacaccaggtgtcctgtccattctcaggctggtcacatgggtggtcctagggtgtcccatgagagatgcaaagcgcctgaattttctgactcttcccatcagaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctcttctcagggaaagcaggagcccttctggagcccttcagcagggtcagggcccctcgtcttcccctcctttcccagagccatcttcccagtccaccatccccatcgtgggcattgttgctggcctggctgtcctagcagttgtggtcatcggagctgtggtcgctactgtgatgtgtaggaggaagagctcaggtagggaaggggtgaggggtggggtctgggttttcttgtcccactgggggtttcaagccccaggtagaagtgttccctgcctcattactgggaagcagcatccacacaggggctaacgcagcctgggaccctgtgtgccagcacttactcttttgtgcagcacatgtgacaatgaaggacggatgtatcaccttgatggttgtggtgttggggtcctgatttcagcattcatgagtcaggggaaggtccctgctaaggacagaccttaggagggcagttggtccaggacccacacttgctttcctcgtgtttcctgatcctgccttgggtctgtagtcatacttctggaaattccttttgggtccaagacgaggaggttcctctaagatcttaaggccctgcttcctcccagtcccctcacaggacattttcttcccacaggtggaaaaggagggagctactctcaggctgcgtgtaagtggtgggggtgggagtgtggaggagctcacccaccccataattcctcctgtcccacgtctcctgcgggctctgaccaggtcctgtttttgttctactccagccagcgacagtgcccagggctctgatgtgtctctcacagcttgaaaaggtgagattcttggggtctagagtgggcggggggggcggggagggggcagaggggaaaggcctgggtaatggagattctttgattgggatgtttcgcgtgtgtcgtgggctgttcagagtgtcatcacttaccatgactaaccagaatttgttcatgactgttgttttctgtagcctgagacagctgtcttgtgagggactgagatgcaggatttcttcactcctcccctttgtgacttcaagagcctctggcatctctttctgcaaacggcacctgaatgtgtctgcgtccctgttagcctaatgtgaggaggtggagagacagcccacccccgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaacttgttttctcaaatatttgctatgagaggttgatggattaattaaataagtcaattcctggaatttgagagagcaaataaagacctgaga

SEQ ID NO: 4441 - DNA, 1093 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaag

SEQ ID NO: 4442 - DNA, 1119 bp, Homo sapiens
atgcgggtcatggcgccccaagccctcctcctgctgctctcgggagccctggccctgatcgagacctgggccggctcccactccatgaggtatttctacaccgccgtgtcccggcccggccgcggagagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccggttctcacaccatccagaggatgtatggctgcgacctggggcccgacgggcgcctcctccgcgggtataaccagttcgcctacgacggcaaggattacatcgccctgaacgaggacctgcgctcctggaccgcggcggacacggcggctcagatctcccagcgcaagttggaggcggcccgtgaggcggagcagctgagagcctacctggagggcgagtgcgtggagtggctccgcggatacctggagaacgggaaggagacgctgcagcgcgcggaacgcccaaagacacacgtgacccaccatcccgtctctgaccatgaggccaccctgaggtgctgggccctgggcttctaccctgcggagatcacactgacctggcagcgggatggggaggaccaaactcaggacaccgagcttgtggagaccaggccagcaggagatggaaccttccagaagtgggcagctgtggtggtgccttctggacaagaacagagatacacgtgccatgtgcagcacgaggggctgcaggagccctgcaccctgagatggaagccgtcttcccagcccaccatccccaacttgggcatcgtttctggcccagctgtcctggctgtcctggctgtcctggctgtcctagctgtcctaggagctgtggtcgctgctgtgatacataggaggaagagctcaggtggaaaaggagggagctgctctcaggctgcgtccagcaacagtgcccagggctctgatgagtctctcatcgcttgtaaagcctga

SEQ ID NO: 4443 - DNA, 1522 bp, Homo sapiens
atgcgggtcatggagccccgaaccctcatcctgctgctctcgggagccctggccctgaccgagacctgggcctgctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcggggccgctgggtggagcaggaggggccggagtattgggaccgggagacacagaagtacaaccgccaggcacagactgaccgagtgaacctgcggaaactgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggaggagtggagagcctacctggagggcgagtgcgtggagtggctccgcagatacctggagaacgggaaggagaagctgcagcgcgcggaacacccaaagacacacgtgacccaccatcccgtctctgaccatgaggccaccctgaggtgctgggccctgggcttctaccctacggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttctaaagcctgagacagctgcctgtgtgggactgagatgcaggatttcctcacacctctcctttgtgacttcaagagcctctggcatctctttctacaaaggcatctgaatgtgtctgcgtccctgttagcataatgtgaggaggtggagagaccagcccacccccgtgtccaccgtgacccctgtccccacactgacctgtgttccctccccgatcatctttcctgttccagagaagtgggctggatgtctccatctctgtctcaactttacgtggcctgacgtgcaacttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 4444 - DNA, 1098 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaagcctgag

SEQ ID NO: 4445 - DNA, 1101 bp, Homo sapiens
atgcgggtcatggcgccccgaaccctcctcctgctgctctcgggagccctggccctgaccgagacctgggcctgctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactacgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggagcagtggagagcctacctggagggcgagtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctacggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 4446 - DNA, 4543 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 4447 - DNA, 4882 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 4448 - DNA, 5148 bp, Homo sapiens
ggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttgg

SEQ ID NO: 4449 - DNA, 5026 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 4450 - DNA, 4315 bp, Homo sapiens
ggaaattgttcctcgtctgataagacaacagtggagaaaggacgcatgctgtttcttagggacacggctggcttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagaccttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcttggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggctaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgagtgtatatgtatgtgtgtatgggtgtgtgtttgtgtgagagacagagaaagagagagaattc

SEQ ID NO: 4451 - DNA, 5292 bp, Homo sapiens
ggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttgg

SEQ ID NO: 4452 - DNA, 5292 bp, Homo sapiens; identical to SEQ ID NO: 4451

SEQ ID NO: 4453 - DNA, 894 bp, Homo sapiens
tttgctgagactttggactgtggacttttgagttaattctgaaatgagagtttctctgcacaagctctctctttgcctgctgtcatccacataagatgtgacttgctcctccttgccttctgccattattgtgaggtctccccagccatgtggaactatggacatggcctggcagatgatgcagctgctccttctggctttggtaactgctgcggggagtgcccagcccaggagtgcgcgggccaggacagacctgctcaatgtctgcatgaacgccaagtaccacaagacacagcccagccccgaggacgagctgtatggccagacccatgatgtgcaaggggtcttgcaggaagaccaagagttgggacagccaaggaaaagcaagtgtgaagttgtgctggcggggaagcatgttctgtgtcggccggcactgggcgtggtggcccagtggaagaagaatgcctgctgcatgaccaacaccagccaggagctgcacaaggacacctcccgcctgtacaactttaactgggatcactgtggtaagatggagcctgcctgcaagcgccactttatccaggacaccggtctctatgagtgctcacccaacctcgggccctggatctggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggcctgggccctctgccacacctttgagccctacttccccactccagctgccctttgtgaaggcctctggagccattccttcaaggtcagcaactacaactacagctgagg

SEQ ID NO: 4454 - DNA, 865 bp, Homo sapiens
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgtgtct

SEQ ID NO: 4455 - DNA, 762 bp, Homo sapiens
tttgctgagactttggactgtggacttttgagttaattctgaaatgagagtttctctgcacaagctctctctttgcctgctgtcatccacataagatgtgacttgctcctccttgccttctgccattattgtgaggtctccccagccatgtggaactatggacatggcctggcagatgatgcagctgctccttctggctttggtaactgctgcggggagtgcccagcccaggagtgcgcgggccaggacagacctgctcaatgtctgcatgaacgccaagtaccacaagacacagcccagccccgaggacgagctgtatggccagtgcagtccctagaagaagaatgcctgctgcatgaccaacaccagccaggagctgcacaaggacacctcccgcctgtacaactttaactgggatcactgtggtaagatggagcctgcctgcaagcgccactttatccaggacaccggtctctatgagtgctcacccaacctcgggccctggatctggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggcctgggccctctgccacacctttgagccctacttccccactccagctgccctttgtgaaggcctctggagccattccttcaaggtcagcaacta

SEQ ID NO: 4456 - DNA, 819 bp, Homo sapiens
cgcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctatgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgaaaaaaaaaaa

SEQ ID NO: 4457 - DNA, 1012 bp, Homo sapiens
gaaaagcagcaaaccagatggagaaggaaggccaaaaagataagtagaaagctggaccatgagctccttgagggcagggactgaatggttactatgtccccagggcccagcatgaccttctcctggattcctcatcttccttctgtgacctgtgtctccatcagtttctcctccggcatctttttcttacaggattcttacctcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgtgtct

SEQ ID NO: 4458 - DNA, 2030 bp, Homo sapiens
ccggaaattgcgtcaccccaacttcggtcgggggccggggggcgtgccagttgggtacgcggtccagtcagaatgcaacacgaggggtttcggaaggccagccgccatgccgcccctaaactgggaactcctccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcagcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctgtgagcgccgggcctggcggcgggcggggctcggggccgctgagccaggctcttgggacgcaggcacggcccggcagcccccggggtcgggacccccggcgcgcccggaactgaagggctcccttgctgcccgccttgggggccatgtcaggggctccctgggggtgagagccgggctgggagccggggggccgtcccgatgcccgccctgcgcacggcaggatcttcctgttagtgcgagaagaacaggatcgacctgtgtgagcaaacagagcaagccagtgtccagccttgccgagtcctcccggggccgacccggaagggcccccgctcctgcccaccccaccttcagcttgccacagcagtccttccgatggtgtctcagaggagaatcccaagccttcctcacgtccataaggatttgagctctgtccctggggtgggaaccttgtgcctgacacagctgctaactctattgacagatcgtcttattctcaccctaagcaactcagggtctgtggtgacggatgtgcatctcatactcacagctagtgctggtacaggccgccacggtcacttcttcacttttgtctgtagtcttaaagggaaagtctaggggagatccttaccttagttgcctgtggggaataagaagtcagcaaccattgaaaggtttgtctggctgtgctgatggtgacatagcagagtgggggctggtgttggttggtggtagtttgtcgttcacggcctctgtcctgatattgcccaagaacaccaggctatcagctcagccttgtgcgttaggaggggttatcttggtgagtagataaggtttttatgaagggaaatgccagaggaaaaagggaagcactactgagggatcaaggctgctttagggatcaaggctgctttctagcatctatttccgcttccagatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgtggctgtgcactgcccttgaactgtctttagagagggactggcctgccgacttggaagggcaggggcagctgtctgagcggtggggaggccgggttccagaggcttggag

SEQ ID NO: 4459 - DNA, 2714 bp, Homo sapiens
ccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcaggggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 4460 - DNA, 2492 bp, Homo sapiens
ccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgcctcctcggagaagcttgtcccccgtgtgggagggacggagccggactggacatggtcactcagtaccgc

SEQ ID NO: 4461 - DNA, 2492 bp, Homo sapiens; identical to SEQ ID NO: 4460

SEQ ID NO: 4462 - DNA, 2441 bp, Homo sapiens
cgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcaggggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 4463 - DNA, 2492 bp, Homo sapiens; identical to SEQ ID NO: 4460

SEQ ID NO: 4464 - DNA, 2492 bp, Homo sapiens; identical to SEQ ID NO: 4460

SEQ ID NO: 4465 - DNA, 1852 bp, Homo sapiens
gactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagtaagtgtacggttttgtccagtgtgaatcctaagactgaaaactttggggggacactgaaaaaaaatcctagaatttagaaaaagagaattatttgatttcttatttcctctttctgttcaggccttctgaaagtaaaggttcttcctttaactgttccctgttctttcttctattccttctttgtcctactcaaagggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaaacttttctatccctgtgtcatcattttcactactttctcctttggttagtcctttggaatatgtttttgttctgtttctgtcttttgctttcttccccccctgcaacttttgggcgtgtatttgtagtcatcagaaatttgggccaaggggagcggatcacgaggtcaggagatcgagactatcctggctaacacggtg

SEQ ID NO: 4466 - DNA, 282 bp, Homo sapiens
atgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtag

SEQ ID NO: 4467 - DNA, 496 bp, Homo sapiens
gagcagccttcctgagagaggagagagaaagctcagggaggtctggagcaaagatactcctggaggtggggagtgaggcagggataaggaaggagagtatcctccagcaccttccagtgggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcat

SEQ ID NO: 4468 - DNA, 496 bp, Homo sapiens; identical to SEQ ID NO: 4467

SEQ ID NO: 4469 - DNA, 3445 bp, Homo sapiens
gcccgggggcccagcgcgggccttggcggaagaggaggaggaggaggaggcagaggagaagagcacggaggaaagggtgccaggctggggctggaaccccctggcaaaggatggggtcccctcatccctaaacagcaagccatctcccctcgcccgccccccgcccccccagtctcggagatctcagaggcaccgactgggagggaaaggaaacccccatttaggaggccggggaggccccagcaaccacacacacacagagacacacagactcacacgcggccgcccacacgcagtcgcctgcgtcagcaccagccgtcaggccctcgctgcccgcctgcggggtgtggagtggggagaacagccccgcctgaatccagtccgactacccgcccctactgatttgcctgggacgccgccggcccacatggccccacccacgcctctgtccccacccccccacgcctctgtccccacccccccaccgcccccggcagcgttccccccttaacaccttcccccaggtgtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccag

SEQ ID NO: 4470 - DNA, 3181 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 4471 - DNA, 3401 bp, Homo sapiens
gtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaacaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 4472 - DNA, 3445 bp, Homo sapiens; identical to SEQ ID NO: 4469

SEQ ID NO: 4473 - DNA, 3372 bp, Homo sapiens
gtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 4474 - DNA, 3091 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 4475 - DNA, 3585 bp, Homo sapiens
gtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttcta

SEQ ID NO: 4476 - DNA, 846 bp, Homo sapiens
cacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaa

SEQ ID NO: 4477 - DNA, 737 bp, Homo sapiens
cctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaac

SEQ ID NO: 4478 - DNA, 2144 bp, Homo sapiens
gcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataattaatggctccaagtatttgcggagttccacgtttgccagctaggatcaaatccccgtggtagctagccaatacttgatttttccagtgagtattttgctctgtacctaaatctgtgccacagaatcttctgtgtccctagattccacgagctttttaagactacaataagaggatacatgcttttacacttttacatgcacagtttgtaagtctgtgcagaattgccctgcatcattgaaaggaaaaagagaaggtgctgaaaagttacacaaacacaccatacccctgtgagctactgctaggaacataaagtaggccctggtttggtgagatggtgttaagcatacagaagaggagtaaggtgtagacagtgagggtaacctgagggactgtgagaggtcattactcatttccttctaggcagacacactgaaaggtgggtataggtaggagaccagagacaacccctttaggctgcgtggcattggccttcatctgggcatgaatgagacattaataggtggttctggctggaaaagtaggtaagagtacgttttctgatgggagaagataattggatatgattaaaggttggagaagatttgttcaacaaatctgtaatagacctgaagaatggtagaacctgagtgataagaaatgggtaagaaaatggaaggacttatcacccaagaaatgatacatgctacaaacttcc

SEQ ID NO: 4479 - DNA, 1600 bp, Homo sapiens
gcagtcccaaaaagcctctcaggcacacaacccagcacagcaaggcagtcacaccaagattcccctcttcccgcggcctcgccatggcgacccacggacagacttgcgcgcgtcgtaactggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataaggctggagtgcagtggtgcggtctcggctcactgcaacctccgtctcccgggttcaagcaattctgcctcagcctcccgagtagctgggattacaagc

SEQ ID NO: 4480 - DNA, 2219 bp, Homo sapiens
gcagtcccaaaaagcctctcaggcacacaacccagcacagcaaggcagtcacaccaagattcccctcttcccgcggcctcgccatggcgacccacggacagacttgcgcgcgtcgtaactggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataattaatggctccaagtatttgcggagttccacgtttgccagctaggatcaaatccccgtggtagctagccaatacttgatttttccagtgagtattttgctctgtacctaaatctgtgccacagaatcttctgtgtccctagattccacgagctttttaagactacaataagaggatacatgcttttacacttttacatgcacagtttgtaagtctgtgcagaattgccctgcatcattgaaaggaaaaagagaaggtgctgaaaagttacacaaacacaccatacccctgtgagctactgctaggaacataaagtaggccctggtttggtgagatggtgttaagcatacagaagaggagtaaggtgtagacagtgagggtaacctgagggactgtgagaggtcattactcatttccttctaggcagacacactgaaaggtgggtataggtaggagaccagagacaacccctttaggctgcgtggcattggccttcatctgggcatgaatgagacattaataggtggttctggctggaaaagtaggtaagagtacgttttctgatgggagaagataattggatatgattaaaggttggagaagatttgttcaacaaatctgtaatagacctgaagaatggtagaacctgagtgataagaaatgggtaagaaaatggaaggacttatcacccaagaaatgatacatgctacaaacttcc

SEQ ID NO: 4481 - DNA, 2144 bp, Homo sapiens; identical to SEQ ID NO: 4478

SEQ ID NO: 4482 - DNA, 1600 bp, Homo sapiens; identical to SEQ ID NO: 4479

SEQ ID NO: 4483 - DNA, 1185 bp, Homo sapiens
tcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccctggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagacgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttgaattggttatctagttaccaatgctgcagtcctgcagtcacctatacattatttaaatgtatttaactgttaaatgcgctacccaccaataatgaaatagacctttatgaaaa

SEQ ID NO: 4484 - DNA, 1471 bp, Homo sapiens
gcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgagtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataaggctggagtgcagtggtgcggtctcggctcactgcaacctccgtctcccgggttcaagcaattctgcctcagcctcccgagtagctgggattacaagc

SEQ ID NO: 4485 - DNA, 1464 bp, Homo sapiens
gctgctggagctgcagcccgaccgcgagcgtgccaagcggcttcagcagctagcggacgtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttggctcgccctggagttggaggcttaatccagctgaaagaaacctttgggaatggatatcagaagatttggccttaatatatttccattgtgaccagcagcaggcttttttccccccagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtg

SEQ ID NO: 4486 - DNA, 2086 bp, Homo sapiens
attcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataattaatggctccaagtatttgcggagttccacgtttgccagctaggatcaaatccccgtggtagctagccaatacttgatttttccagtgagtattttgctctgtacctaaatctgtgccacagaatcttctgtgtccctagattccacgagctttttaagactacaataagaggatacatgcttttacacttttacatgcacagtttgtaagtctgtgcagaattgccctgcatcattgaaaggaaaaagagaaggtgctgaaaagttacacaaacacaccatacccctgtgagctactgctaggaacataaagtaggccctggtttggtgagatggtgttaagcatacagaagaggagtaaggtgtagacagtgagggtaacctgagggactgtgagaggtcattactcatttccttctaggcagacacactgaaaggtgggtataggtaggagaccagagacaacccctttaggctgcgtggcattggccttcatctgggcatgaatgagacattaataggtggttctggctggaaaagtaggtaagagtacgttttctgatgggagaagataattggatatgattaaaggttggagaagatttgttcaacaaatctgtaatagacctgaagaatggtagaacctgagtgataagaaatgggtaagaaaatggaaggacttatcacccaagaaatgatacatgctacaaacttcc

SEQ ID NO: 4487 - DNA, 4712 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagataccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagttt

SEQ ID NO: 4488 - DNA, 4637 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 4489 - DNA, 4712 bp, Homo sapiens; identical to SEQ ID NO: 4487

SEQ ID NO: 4490 - DNA, 4854 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagataccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagttt

SEQ ID NO: 4491 - DNA, 4854 bp, Homo sapiens; identical to SEQ ID NO: 4490

SEQ ID NO: 4492 - DNA, 4495 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 4493 - DNA, 2697 bp, Homo sapiens
ggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacatcgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattcgataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttt

SEQ ID NO: 4494 - DNA, 2712 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcattttctccgagcaggcctggccgcgctctccccgcttcttcgcagtcttcggccctctcctgtcgccgccatgagcactggcaccttcgtcgtgtcgcagccgctcaattaccgcggcggggccgctggagccggcggacgctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtgaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaccttgttcctttataggttcctggtagaatcagtagagatgatttcagctcattgacatttttaagctgtatccccttgtcattccattgagaaagctgacaactgggatagggaggggattagataatagatggggtcaaattctgtgtgaatgtgaacttgcctagtaagcactttgtctctgttcactactgcgatagaggaaatctactccctatcttgggtccttgaactacagcctgctgtcttacaccagtggagctaccctttaaatgtacaaattaatttgtatgctaatgtaatatggtgaaattaaaataaatcacactgttaattgttaaaaaaaaaaaaaaaaaggaattc

SEQ ID NO: 4495 - DNA, 4387 bp, Homo sapiens; identical to SEQ ID NO: 3608

SEQ ID NO: 4496 - DNA, 1989 bp, Homo sapiens
cccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagtttgtggagctcactgtgtctttgctgatccttcagcaaaggaagtgagattgtttctagcttttctgtttggggtgcttctctgtcaactaaaagtcttcatccttcaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacttaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaagctcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctc

SEQ ID NO: 4497 - DNA, 2433 bp, Homo sapiens
ccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatc

SEQ ID NO: 4498 - DNA, 2369 bp, Homo sapiens
ccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccggtgatgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgccccc

SEQ ID NO: 4499 - DNA, 2433 bp, Homo sapiens; identical to SEQ ID NO: 4497

SEQ ID NO: 4500 - DNA, 2580 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgaca

SEQ ID NO: 4501 - DNA, 2010 bp, Homo sapiens
gtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 4502 - DNA, 3096 bp, Homo sapiens
actgaccaccccaccagtcctctgccccagtccctctgccttcactcccatggccacctgtgctccagggcctgcctgacccctgtccagcggccctgaagtaaggtctgtgatgtctaaatgccgatacctcagtttccccatctttagaacggggctcttgtttggaactgtgcccgccacagcctgcacgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgaca

SEQ ID NO: 4503 - DNA, 3096 bp, Homo sapiens; identical to SEQ ID NO: 4502

SEQ ID NO: 4504 - DNA, 2010 bp, Homo sapiens; identical to SEQ ID NO: 4501

SEQ ID NO: 4505 - DNA, 856 bp, Homo sapiens
aggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgat

SEQ ID NO: 4506 - DNA, 2271 bp, Homo sapiens
ccttcaccatgagctgtgggcagtggccatgacttacctgattctggatcaacaaagaagatgttcaaatacaattgacaaatgtaggccaataggtacagtggctcacacctgtcatcccagcactttgccaaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggc

SEQ ID NO: 4507 - DNA, 2797 bp, Homo sapiens; identical to SEQ ID NO: 3052

SEQ ID NO: 4508 - DNA, 5674 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4509 - DNA, 5468 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctgcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4510 - DNA, 5674 bp, Homo sapiens; identical to SEQ ID NO: 4508

SEQ ID NO: 4511 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 4512 - DNA, 3858 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4513 - DNA, 5619 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 4514 - DNA, 4874 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4515 - DNA, 5452 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggagctttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4516 - DNA, 4723 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4517 - DNA, 4633 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcgagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4518 - DNA, 4605 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 4519 - DNA, 4335 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4520 - DNA, 5053 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 4521 - DNA, 5674 bp, Homo sapiens; identical to SEQ ID NO: 4508

SEQ ID NO: 4522 - DNA, 4874 bp, Homo sapiens; identical to SEQ ID NO: 4514

SEQ ID NO: 4523 - DNA, 5001 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 4524 - DNA, 2457 bp, Homo sapiens
ggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaaca

SEQ ID NO: 4525 - DNA, 2457 bp, Homo sapiens; identical to SEQ ID NO: 4524

SEQ ID NO: 4526 - DNA, 2428 bp, Homo sapiens
cgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaac

SEQ ID NO: 4527 - DNA, 2457 bp, Homo sapiens; identical to SEQ ID NO: 4524

SEQ ID NO: 4528 - DNA, 2457 bp, Homo sapiens; identical to SEQ ID NO: 4524

SEQ ID NO: 4529 - DNA, 2289 bp, Homo sapiens
cgagtgcgcacaggactgaacgagcacgcccggtccctgctccggagcggaggacacgacgcggacccgcacggtgcaccgcagtgacctgaggaaggagcgacgggcgctcgcgccaaaggcgtccgagtgcctggtaaactgtaaagcgcggtcctgcagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggcaagtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtctttttttttttttttttttttttgctcctggcaagctgtgcgtgacattctttatggctttttgtatgtcaaatacttcatactaaactttctagagaattaaactttaatgatgggctca

SEQ ID NO: 4530 - DNA, 1901 bp, Homo sapiens
cgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcacactgaaaaaaaaaaaaaaaaaa

SEQ ID NO: 4531 - DNA, 2288 bp, Homo sapiens
agggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtctttttttttttttttttttttttgctcctggcaagctgtgcgtgacattctttatggctttttgtatgtcaaatacttcatactaaactttctagagaattaaactttaatgatgggctca

SEQ ID NO: 4532 - DNA, 3184 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagcagcacgtgtttgggcgaggtgggaactcgtctggccgcggggggtccccggctccctatgtggacaccttcctcaacgccccggacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccgtggctgcccgcgcgccccggggccacgccgccaggccctggctgggccttctcctgtcgcctgtgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 4533 - DNA, 3254 bp, Homo sapiens
cgtttcagcccattctggggccgtttctagtgtggttaacgtacaaaaataaacaaatcccctaaaagtcccacgcggacatcggcgggagcccagggccggacgccgcggtgtggagcgagggcgccggcgcggactatgagggcccaccgcgcctcgtccagggctcacttaagagcagcgtgagcagcgcttgggaccgccgtccgggacgcccgcagccctttaggatggaggccaccgtgacctccgccaccgaagcaccgcgctcccctagtcccctcagccggtcgccgttccccgccgcgcaggcgcaggagccgcggcgagcccctcggtcacgcctcgcccctcggtcacgcctcgcccctcggtcacgcctcgcccctcggtcacgcctcgcccctcggtcacgcctcgcccctcggtcacgcctcgcccatccgcgccgcgcaggcgcactgagcctcagccgctctcctcgctaccaggctcctttcctctatcgcgcaggcgcactgaacctcagccgcgccgggaggcgagcccgttggcgaggggcggggcggatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacactccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctg

SEQ ID NO: 4534 - DNA, 2556 bp, Homo sapiens
agagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccagtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagacttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgcaagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccggaagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttcaattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactaccaagaaaaaaaaaaaaaaa

SEQ ID NO: 4535 - DNA, 3023 bp, Homo sapiens
cgtttcagcccattctggggccgtttctagtgtggttaacgtacaaaaataaacaaatcccctaaaagtcccacgcggacatcggcgggagcccagggccggacgccgcggtgtggagcgagggcgccggcgcggactatgagggcccaccgcgcctcgtccagggctcacttaagagcagcgtgagcagcgcttgggaccgccgtccgggacgcccgcagccctttaggatggaggccaccgtgacctccgccaccgaagcaccgcgctcccctagtcccctcagccggtcgccgttccccgccgcgcaggcgcaggagccgcggcgagcccctcggtcacgcctcgcccctcggtcacgcctcgcccctcggtcacgcctcgcccctcggtcacgcctcgcccctcggtcacgcctcgcccctcggtcacgcctcgcccatccgcgccgcgcaggcgcactgagcctcagccgctctcctcgctaccaggctcctttcctctatcgcgcaggcgcactgaacctcagccgcgccgggaggcgagcccgttggcgaggggcggggcggatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacactccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattcccctcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccacccgccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagct

SEQ ID NO: 4536 - DNA, 3023 bp, Homo sapiens; identical to SEQ ID NO: 4535

SEQ ID NO: 4537 - DNA, 6232 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgctccttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactataggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggatttggcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctctactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaacccaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatacctgctcct

SEQ ID NO: 4538 - DNA, 5990 bp, Homo sapiens
gaaagcgaagggggtagggctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacct

SEQ ID NO: 4539 - DNA, 6313 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgctccttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactataggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggatttggcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctctactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaacccaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatacctgctcct

SEQ ID NO: 4540 - DNA, 5990 bp, Homo sapiens; identical to SEQ ID NO: 4538

SEQ ID NO: 4541 - DNA, 5990 bp, Homo sapiens; identical to SEQ ID NO: 4538

SEQ ID NO: 4542 - DNA, 6068 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacct

SEQ ID NO: 4543 - DNA, 6068 bp, Homo sapiens; identical to SEQ ID NO: 4542

SEQ ID NO: 4544 - DNA, 6068 bp, Homo sapiens; identical to SEQ ID NO: 4542

SEQ ID NO: 4545 - DNA, 6068 bp, Homo sapiens; identical to SEQ ID NO: 4542

SEQ ID NO: 4546 - DNA, 5990 bp, Homo sapiens; identical to SEQ ID NO: 4538

SEQ ID NO: 4547 - DNA, 3759 bp, Homo sapiens; identical to SEQ ID NO: 3310

SEQ ID NO: 4548 - DNA, 2280 bp, Homo sapiens
cagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagtctagattgaaaatgtcaactccagacatcactgtgcttctggaaactataaagaggaagtgggagctaggacatccccccaccacgccccgcccaagagcgtttacgtgtgttatattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaa

SEQ ID NO: 4549 - DNA, 1980 bp, Homo sapiens
ctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaaaaaaaaaaaaaaaaaa

SEQ ID NO: 4550 - DNA, 871 bp, Homo sapiens
attttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatgctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataa

SEQ ID NO: 4551 - DNA, 2173 bp, Homo sapiens
cagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaa

SEQ ID NO: 4552 - DNA, 1694 bp, Homo sapiens
ccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 4553 - DNA, 1694 bp, Homo sapiens; identical to SEQ ID NO: 4552

SEQ ID NO: 4554 - DNA, 1694 bp, Homo sapiens; identical to SEQ ID NO: 4552

SEQ ID NO: 4555 - DNA, 1694 bp, Homo sapiens; identical to SEQ ID NO: 4552

SEQ ID NO: 4556 - DNA, 2183 bp, Homo sapiens
agggccgggtcgccacagcccagggcctctggctaggctggtcgccgtcttacctccgggcccgcctcccgcccagctcctccgtccttggacgggatgggcccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 4557 - DNA, 1805 bp, Homo sapiens
ctccgggcccgcctcccgcccagctcctccgtccttggacgggatgggcccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 4558 - DNA, 1486 bp, Homo sapiens
tcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaggcgctaccaccagtcgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttcgtgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagatcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcag

SEQ ID NO: 4559 - DNA, 3518 bp, Homo sapiens
ggcttgtttacggcccgactgcgcaggcgtgctcacctggcgtgctccacccgactgggcgtccgcaggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaaggttggtgtaactgcctctggtgatgagatggtttctctcaaggactactgcaccagaatgaaggagaaccagaaacatatctattatatcacaggtgagaccaaggaccaggtagctaaggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccaacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggcctt

SEQ ID NO: 4560 - DNA, 3635 bp, Homo sapiens
ggcttgtttacggcccgactgcgcaggcgtgctcacctggcgtgctccacccgactgggcgtccgcaggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggcc

SEQ ID NO: 4561 - DNA, 2912 bp, Homo sapiens
cagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaactttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaatatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggttctttcacagatggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaatactcgagcccagtcttgtggatggaaatgtagtgctcgagtcacattctgcttaaagttgtaacaaatacagatgagt

SEQ ID NO: 4562 - DNA, 3635 bp, Homo sapiens; identical to SEQ ID NO: 4560

SEQ ID NO: 4563 - DNA, 1136 bp, Homo sapiens; identical to SEQ ID NO: 3554

SEQ ID NO: 4564 - DNA, 2690 bp, Homo sapiens
ctgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 4565 - DNA, 2690 bp, Homo sapiens; identical to SEQ ID NO: 4564

SEQ ID NO: 4566 - DNA, 2690 bp, Homo sapiens; identical to SEQ ID NO: 4564

SEQ ID NO: 4567 - DNA, 2488 bp, Homo sapiens
gttccgtccggacggcgtttccacggacgcccaggagacagccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgct

SEQ ID NO: 4568 - DNA, 2758 bp, Homo sapiens
gtttccacggacgcccaggagacagccggttgctgagccgggagcgctgactggcccggctgggcaggctgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 4569 - DNA, 2690 bp, Homo sapiens; identical to SEQ ID NO: 4564

SEQ ID NO: 4570 - DNA, 1855 bp, Homo sapiens
cctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtgatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgt

SEQ ID NO: 4571 - DNA, 1882 bp, Homo sapiens; identical to SEQ ID NO: 4106

SEQ ID NO: 4572 - DNA, 4160 bp, Homo sapiens
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccataagccattccagtctcctgtgaagccaaaagggaccaggaaccgtgcaaaggaaactggaaacttttccccgctgggtagagca

SEQ ID NO: 4573 - DNA, 4160 bp, Homo sapiens; identical to SEQ ID NO: 4572

SEQ ID NO: 4574 - DNA, 3563 bp, Homo sapiens
ctccagccggcggctgctccagggaggctgggcgcgatcctctccgcccgcggctccaacccgcactctgcgcctctcctcgcctttctcgcacctgctcctgcgccaggccgcgagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctccctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttaaaaaaaaaaaaaaaaaaaaaaa

SEQ ID NO: 4575 - DNA, 4286 bp, Homo sapiens
accgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacccgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggacttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggg

SEQ ID NO: 4576 - DNA, 4286 bp, Homo sapiens; identical to SEQ ID NO: 4575

SEQ ID NO: 4577 - DNA, 1829 bp, Homo sapiens
cccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacccgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgg

SEQ ID NO: 4578 - DNA, 4730 bp, Homo sapiens
ttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 4579 - DNA, 4853 bp, Homo sapiens
ttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 4580 - DNA, 4654 bp, Homo sapiens
ttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccaggcaagtggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggacctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcgggggggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggc

SEQ ID NO: 4581 - DNA, 4781 bp, Homo sapiens
ttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctggcaattcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccaggcaagtggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggacctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcgggggggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggc

SEQ ID NO: 4582 - DNA, 4950 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaacccacagtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaggagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaaacacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacagg

SEQ ID NO: 4583 - DNA, 9409 bp, Homo sapiens; identical to SEQ ID NO: 2935

SEQ ID NO: 4584 - DNA, 9211 bp, Homo sapiens; identical to SEQ ID NO: 2930

SEQ ID NO: 4585 - DNA, 9094 bp, Homo sapiens; identical to SEQ ID NO: 2931

SEQ ID NO: 4586 - DNA, 9166 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagaagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccg

SEQ ID NO: 4587 - DNA, 9444 bp, Homo sapiens; identical to SEQ ID NO: 2933

SEQ ID NO: 4588 - DNA, 3410 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttaccccatggtacccggatcctcgaattc

SEQ ID NO: 4589 - DNA, 3730 bp, Homo sapiens
caggaagcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagttccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaag

SEQ ID NO: 4590 - DNA, 3730 bp, Homo sapiens; identical to SEQ ID NO: 4589

SEQ ID NO: 4591 - DNA, 3730 bp, Homo sapiens; identical to SEQ ID NO: 4589

SEQ ID NO: 4592 - DNA, 1501 bp, Homo sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaaaaaaa

SEQ ID NO: 4593 - DNA, 1664 bp, Homo sapiens
cccacgtgggggctcagcgtgcacccttctttgtgctcgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagccttgctgtcttcgtgtcttaccccttcgtggggctacacattctcttcctcatattttcatgcacacaagttaacaactgaaaaagcgtagagtcatgaccttatttatttacaagcacaggataagtccctaacctcccccaaagactgagcaaccctacccagcccagttaaatactgcaactgggggggtaaaaaaggtcgggaggaggaattaagggaaatacaggaataggggaacatatcccacattaaatagttatatacacatcagttcctgtggttctgtacagagcagcggctgaccccacccccacaggacacaatgtggggagagg

SEQ ID NO: 4594 - DNA, 1364 bp, Homo sapiens
ccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaaaaaaa

SEQ ID NO: 4595 - DNA, 1664 bp, Homo sapiens; identical to SEQ ID NO: 4593

SEQ ID NO: 4596 - DNA, 1664 bp, Homo sapiens; identical to SEQ ID NO: 4593

SEQ ID NO: 4597 - DNA, 1664 bp, Homo sapiens; identical to SEQ ID NO: 4593

SEQ ID NO: 4598 - DNA, 1755 bp, Homo sapiens
gccatcgggccggtgcagatacggggttgctcttttgctcataagaggggcttcgctggcagtctgaacggcaagcttgagtcaggacccttaattaagatcctcaattggctggagggcagatctcgcgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagccttgctgtcttcgtgtcttaccccttcgtggggctacacattctcttcctcatattttcatgcacacaagttaacaactgaaaaagcgtagagtcatgaccttatttatttacaagcacaggataagtccctaacctcccccaaagactgagcaaccctacccagcccagttaaatactgcaactgggggggtaaaaaaggtcgggaggaggaattaagggaaatacaggaataggggaacatatcccacattaaatagttatatacacatcagttcctgtggttctgtacagagcagcggctgaccccacccccacaggacacaatgtggggagagg

SEQ ID NO: 4599 - DNA, 1664 bp, Homo sapiens; identical to SEQ ID NO: 4593

SEQ ID NO: 4600 - DNA, 4553 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggagcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttgcctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggattgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttct

SEQ ID NO: 4601 - DNA, 1122 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggagcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccgtgtcagcagataattccacttgctctttgacagaggaaatcaagcgctttctgctcagatccaggcaagtggatgccgtatctgtcaagatcaagaaaaataaagttcacagcagcaggattatactttggttgtcacaaagagaaggcagagaaacaagc

SEQ ID NO: 4602 - DNA, 4553 bp, Homo sapiens; identical to SEQ ID NO: 4600

SEQ ID NO: 4603 - DNA, 1682 bp, Homo sapiens
cggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggc

SEQ ID NO: 4604 - DNA, 2821 bp, Homo sapiens
agtcgtcccgaggtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggcgcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggagaggctcttgtccttcctggggtccttgcgaggcgctggcattggagacgacaccaccccacttggcttctctccctgcctaagggaccccgcaccagggaagcagcccaaggccctggctgtgctcagctgggtcccctgagctgcacccacccacactggggagcacagcccagcccagcccagcccagcccagcgcggcccagcgcggcccgggttcctgcccggagcccagtgctcgccccagctctgtgtgggatgatggggcagcccatcttgcccacgggtggacagctgaccaaggtgggccagcccggggtgccctgccctgccaagccaagagggggacgctcaccagctttcaaaggtccgatgctgagtcagcaactacaagttcattgcaaagaagctgcctggcaatccccctcttttggacagggtctctctcttgcccaggctggagtgcagtggcgcaatcttggctcactacagcct

SEQ ID NO: 4605 - DNA, 2821 bp, Homo sapiens; identical to SEQ ID NO: 4604

SEQ ID NO: 4606 - DNA, 2076 bp, Homo sapiens
aacggctcccacagccgggcgttgggggaaagggagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggagaggctcttgtccttcctggggtccttgcgaggcgctggcattggagacgacaccaccccacttggcttctctccctgcctaagggaccccgcaccagggaagcagcccaaggccctggctgtgctcagctgggtcccctgagctgcacccacccacactggggagcacagcccagcccagcccagcccagcccagcgcggcccagcgcggcccgggttcctgcccggagcccagtgctcgccccagctctgtgtgggatgatggggcagcccatcttgcccacgggtggacagctgaccaaggtgggccagcccggggtgccctgccctgccaagccaagagggggacgctcaccagctttcaaaggtccgatgctgagtcagcaactacaagttcattgcaaagaagctgcctggcaatccccctcttttggacagggtctctctcttgcccaggctggagtgcagtggcgcaatcttggctcactacagcct

SEQ ID NO: 4607 - DNA, 2821 bp, Homo sapiens; identical to SEQ ID NO: 4604

SEQ ID NO: 4608 - DNA, 2821 bp, Homo sapiens; identical to SEQ ID NO: 4604

SEQ ID NO: 4609 - DNA, 3129 bp, Homo sapiens
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctcttgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactgtggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcaggagaggctcttgtccttcctggggtccttgcgaggcgctggcattggagacgacaccaccccacttggcttctctccctgcctaagggaccccgcaccagggaagcagcccaaggccctggctgtgctcagctgggtcccctgagctgcacccacccacactggggagcacag

SEQ ID NO: 4610 - DNA, 827 bp, Homo sapiens
gcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaaaaaaaaaaaaaaaaaaaaaaaaaaaaaaaaaaaaa

SEQ ID NO: 4611 - DNA, 1539 bp, Homo sapiens
gaccggacgcggcgacggtgcggggcggcgctggccctgaggtaggcggcggtaagaggggccgcccgcggcccccggctcactccggcactccgggccgctcggcctccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggaggtgcaaacgaggcgtgggtcccggaagctctgttctgcgggtggccgctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccatc

SEQ ID NO: 4612 - DNA, 788 bp, Homo sapiens
cagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattccctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggctgcagg

SEQ ID NO: 4613 - DNA, 3294 bp, Homo sapiens
aatccgctgctgccggcgtcgggtgcgctcggcctcgcccgcggccctccttccccggcttccgctcgccgctcgttcactccacgcgccgctgccgccgccgccgccgtcgtgccgtgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttc

SEQ ID NO: 4614 - DNA, 2430 bp, Homo sapiens
ctccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgcagatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacacctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagg

SEQ ID NO: 4615 - DNA, 3294 bp, Homo sapiens; identical to SEQ ID NO: 4613

SEQ ID NO: 4616 - DNA, 3390 bp, Homo sapiens
gtcccggatttaccagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctggactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaac

SEQ ID NO: 4617 - DNA, 2184 bp, Homo sapiens; identical to SEQ ID NO: 4350

SEQ ID NO: 4618 - DNA, 8168 bp, Homo sapiens
cccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgggacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaagcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatgggcctttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgcccagacaatgttagagagtgccgggggactcatccagacagcccgggccctcgcagtcaacccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactgagatgctgactgcagtccaagagatctcccatctcattgagccgctggcccatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgactgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactcaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccaaggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctac

SEQ ID NO: 4619 - DNA, 8791 bp, Homo sapiens
aactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttcttctgctgctgggacagcagctaccacagttccttgtggctaccaggacattctgttcttcatagctactcagggtatgtcaacaaatccagtccttgaccaaattcaaattttcaaaagaagctttgc

SEQ ID NO: 4620 - DNA, 8187 bp, Homo sapiens
cccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgggacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaagcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctacaaaaaaaaaaaaaaaaaaa

SEQ ID NO: 4621 - DNA, 8791 bp, Homo sapiens
aactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcaggcaagtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttcttctgctgctgggacagcagctaccacagttccttgtggctaccaggacattctgttcttcatagctactcagggtatgtcaacaaatccagtccttgaccaaattcaaattttcaaaagaagctttgc

SEQ ID NO: 4622 - DNA, 3859 bp, Homo sapiens; identical to SEQ ID NO: 2907

SEQ ID NO: 4623 - DNA, 10724 bp, Homo sapiens; identical to SEQ ID NO: 3673

SEQ ID NO: 4624 - DNA, 10724 bp, Homo sapiens; identical to SEQ ID NO: 3673

SEQ ID NO: 4625 - DNA, 3423 bp, Homo sapiens
gcctcccgccccgccgcctcggaagcccctgagagccggcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttaca

SEQ ID NO: 4626 - DNA, 3423 bp, Homo sapiens; identical to SEQ ID NO: 4625

SEQ ID NO: 4627 - DNA, 2673 bp, Homo sapiens
cgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 4628 - DNA, 1902 bp, Homo sapiens
cggctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaaaaaaaaaaaaccg

SEQ ID NO: 4629 - DNA, 2673 bp, Homo sapiens; identical to SEQ ID NO: 4627

SEQ ID NO: 4630 - DNA, 2673 bp, Homo sapiens; identical to SEQ ID NO: 4627

SEQ ID NO: 4631 - DNA, 2673 bp, Homo sapiens; identical to SEQ ID NO: 4627

SEQ ID NO: 4632 - DNA, 2673 bp, Homo sapiens; identical to SEQ ID NO: 4627

SEQ ID NO: 4633 - DNA, 1902 bp, Homo sapiens; identical to SEQ ID NO: 4628

SEQ ID NO: 4634 - DNA, 5303 bp, Homo sapiens
gcgcactcgggcacgcgctcggaagtcgggggtcggcgcggagtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcaggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatattgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgcagaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatctgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaaggttttatctaataaagtgtctcttccattcacg

SEQ ID NO: 4635 - DNA, 5303 bp, Homo sapiens; identical to SEQ ID NO: 4634

SEQ ID NO: 4636 - DNA, 2022 bp, Homo sapiens
cggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctcactgtgttgcccaggctggtctcgaactcctgggctcaagcggtccacctgcctccgcctcc

SEQ ID NO: 4637 - DNA, 2022 bp, Homo sapiens; identical to SEQ ID NO: 4636

SEQ ID NO: 4638 - DNA, 2022 bp, Homo sapiens; identical to SEQ ID NO: 4636

SEQ ID NO: 4639 - DNA, 2022 bp, Homo sapiens; identical to SEQ ID NO: 4636

SEQ ID NO: 4640 - DNA, 4807 bp, Homo sapiens
ccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggagcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaatgtggtctccttatgaatattaggaaacgaagagggccccggaaggcaaccaagggcctcgtgttgcaggtttttctcgagaca

SEQ ID NO: 4641 - DNA, 4807 bp, Homo sapiens; identical to SEQ ID NO: 4640

SEQ ID NO: 4642 - DNA, 3384 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctactggcccacgcccccacctgccctgcgagaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacataaagcaaaagggagatgtggtgctgcagagtgaccacgtgattgagacgctgaccaagacagccctcagtgccaaccgcgtgaacagcatcaacatcaaccagggcagcataacgtttgcagggggccccggcagggatggcaccattgacttcacacccggctcggagctgctcatcaccaaggccaagaacgggcacctggctgtggtcgccccacggctgaattatcggtgataaaggcgcccactggaccatcccaacgcccaaagctttgcttttctcctcctccccttcccagttaccaaagagtcgaatttccagacagggacccagggacaccccgaagcccacctgcaatttcccacctcctgcccatccctttcttgagggagcagcaggggccaggagctaccccaggagtgggccaggccgggccacagcaataggaaagccagggccagagcga

SEQ ID NO: 4643 - DNA, 1493 bp, Homo sapiens
atagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccactt

SEQ ID NO: 4644 - DNA, 1724 bp, Homo sapiens
gccggccgcccaacagggacgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccactt

SEQ ID NO: 4645 - DNA, 1835 bp, Homo sapiens
gccggccgcccaacagggacgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaagatgggctctcactaccttgctcaggccagtctcgagctcctgtccttaagcagtccccccaccgtggcctccctgagtgctgggattacagccgtgagccaccatgccaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccactt

SEQ ID NO: 4646 - DNA, 1480 bp, Homo sapiens
cgcgagccgggaccacgccgacccagcgtgcccaggccgaggaaagcgcggcggcggcagtccgaagacccaccggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 4647 - DNA, 837 bp, Homo sapiens
  misc_feature (1)...(837): n = A,T,C or G
cattgggccgacgtcgcatgctcccggccgccatggccgcgggattacctgcagcaaaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaacgagcaatcactagtgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgaaccggaagcataaagtgtaaagcctggggtgcctaatgaatgagctaactcacattaattgcgttgcgctcactgcccgctttccaatcnggaaactgtcgtgccaactgcattaatgaatcggccaacgcgcggggaaaagcggtttgcgtattgggcgctcttccgcttcctcgctcaatgaatccctgcgctcngtccttccgntgcggnnaacggtatcactcactcnaatt

SEQ ID NO: 4648 - DNA, 1724 bp, Homo sapiens; identical to SEQ ID NO: 4644

SEQ ID NO: 4649 - DNA, 1766 bp, Homo sapiens
ttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 4650 - DNA, 1385 bp, Homo sapiens; identical to SEQ ID NO: 3494

SEQ ID NO: 4651 - DNA, 1609 bp, Homo sapiens
ttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 4652 - DNA, 1442 bp, Homo sapiens
cgggcggcggcggcagcggttggaggttgtaggaccggcgaggaataggaatcatggcggctgcgctgttcgtgctgctgggattcgcgctgctgggcacccacggagcctccggggctgggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgccggcccctcgtgccccaggaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctcc

SEQ ID NO: 4653 - DNA, 2230 bp, Homo sapiens
cccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaat

SEQ ID NO: 4654 - DNA, 2230 bp, Homo sapiens; identical to SEQ ID NO: 4653

SEQ ID NO: 4655 - DNA, 2230 bp, Homo sapiens; identical to SEQ ID NO: 4653

SEQ ID NO: 4656 - DNA, 1722 bp, Homo sapiens
aaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatga

SEQ ID NO: 4657 - DNA, 1863 bp, Homo sapiens
gcgcggagccacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctcccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggttctgatttttctcttttttaaaaacaaacaaacaaactgttgcagattatgagtgaacccccaaatagggtgttttctgccttcaaataaaagtcacccctgcatggtg

SEQ ID NO: 4658 - DNA, 1722 bp, Homo sapiens; identical to SEQ ID NO: 4656

SEQ ID NO: 4659 - DNA, 2230 bp, Homo sapiens; identical to SEQ ID NO: 4653

SEQ ID NO: 4660 - DNA, 719 bp, Homo sapiens
atgccaccgccgctgggagccctgtactatcagccatggtcaaccccactgttcttcaacattgctgacgaaggcaagcccttgggccgcgtctccttcaacctgtttgcagacaagattccaaagacagcagaaaactttcatgctctgagcactggcgagaaaggatttggttttaagggtttccgctttcacagaattattccagggtttatgtatcagggtggtgacttcacacccataatggcactggtggcaagtccatttacggggagaaatttggtgatgaaaacttcatcctaaagcatacaggtcctggcatcttgtccatggcaaatgctggacccaacacaaacggttcccagtttttcatctgcactgccaagactgagtggttggatggcaagcatgtggtctgtggcaaggcgaaagaaggcaagaatattgtggaggccatggagcgctgtggttccaggaatggcaagaccagcaagaagatcaccattgctgactgtgaacaactctaataagtttgacttgtgttttatcttaaccaccagaccattccttctgtagctcaggagagcacccctccaccccatttgctctcagtatcctagaatctttgtgctcttgctgcagttccctttgggttccatgttttccttgttcccttccgtgcctagctggattgcagtgttaagtttatgattatgaat

SEQ ID NO: 4661 - DNA, 3236 bp, Homo sapiens
gagggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccat

SEQ ID NO: 4662 - DNA, 2986 bp, Homo sapiens
ccttgagaaaggattgctggtcatgggaccagaggctttatggggagggaagaactgttcttgactttcagtttttcgagcgggtttcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccat

SEQ ID NO: 4663 - DNA, 1704 bp, Homo sapiens
gaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaatcgtccagggagcattttcctccatcgcagtgttcaaggccatccttccctgtctgccagggccagtcttgacgagtgtgaagcttccttggcttttactg

SEQ ID NO: 4664 - DNA, 1488 bp, Homo sapiens
ggcggtaggagttcggcggaccgagaggttccgcgcccacttcgcggcccagaggactgagcccggcctccggtgcaaggaaaccccagaggccggaactagaattgcaaattttttttcaccccggattccaacggcattctgttataagcaacagagaatgaacgaagacagaaaattggaaccaagaagtgggattttgctgatgacaaatacctgaaaatggggaagcagctttggaactaggttctcactctgttacccagactggagtgcagtgacacgattacagctcattacagcctcaatctcccaggctcaagtgatcttcccacctcagcctcctgagtagctgggactgcaggtacaaaattcagtaggacacgactttctgagtcatatgctggatttgaggagatactgaagccacaagactgaaataacttttaaactgtgggtgatttggctaaaagctactctcatctattatatattcatcttactagttttgctctcagaggaagttcctgtttccaaggacaatgatttaaggcattgaagtggaactgagacacttggatcaaatccctgttctgccacgtgcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcag

SEQ ID NO: 4665 - DNA, 2986 bp, Homo sapiens; identical to SEQ ID NO: 4662

SEQ ID NO: 4666 - DNA, 3355 bp, Homo sapiens
ccttctctctctctctccctctccctctcctgccagccaagtgaagacatgcttacttccccttcaccttccttcatgatggtaagaaacggttgaactggatgcaatttttatcacagcttgtgtaagactgcctctgtccctcctctcacatgccattggttaaccagcagacagtgtgctcaggggcgttgcagctcattgctcttatagcctgtgagggcacggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaaatatttgttccaacctttttcgttggtggcatttatggctttggagcactgtcaggcccatgttcattaccgtgagctcctgtgcatctcctaatttccaaactagcctggaaaacgcctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttatacatataataggtgtaagagattagaggaagcctgtcacctgaagacattccttataccttcatatgtagtacactttgtacataccactctctggagcgctgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagcgaggaaaaagaaatgacaggcatacaaaagagagaagtggaggagaagaattgggggtaaggaggactgggatttctttccttgcctgtacattaatctctccactttcctaaggaggaaacagaaattctcactcttgcaatcactatcttcttccccaatttttctgttttattttctcccttttaagaaccacggctagctagtttgattgtcacgtctagacagttgttgctttcacagttctatgttacatttatcttgctcttcagtcgactacacaaatgatacctcacaattcctttttcccaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatggtaataagagatacaggaagtttacctaaaacactggtttgataaaaaaaatttaatcagatcatgctgtttcctggagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcct

SEQ ID NO: 4667 - DNA, 2794 bp, Homo sapiens
cccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaaggtaggcagcttgtgtgatcaaattaatttcacttttgttctcagcataaatattgtttttatggatatttgaactaagcattttcttaggaggacatagggattataacatagaagaagaatcctaaatctaactcctaattcctttctatgggatacattttgaatccatacttccgtgattgcatgtctataagaaaagaaagtgcagaactctcaaagcctctgcctcaaaaacttgaggaaatgatagtcatctccttgaaggcacaaggtcttagttatgattcctgatttcacctcttgggatgttcacagacacagagtttcatgaagctgtggtgtccagaaaacctgctgcacatagggtgcacaatgagtttccatcttcttgcctctttttaaggggcgagaactcagtccgggagtgtcttaaactacagaccttcatgggaaaccttgttgcttctgcttcctctcttttcacactggaggttttatttttgcttagccatgaattcttgggtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaagtatttgttccaacctttttcgttggtggcatttatggctttggagcactgtcaggcccatgttcattaccgtgagctcctgtgcatctcctaatttccaaactagccttgaaaacacctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagaggtatttatttatacatgtaatagttgtaagagattagagggagcctgtcacctgaagacattccttataccttcatatgtagtacactctgtacataccactctctggagcactgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacgtgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatggtaataagagatacaggaagtttacctaaaacactggtttgataaaaaaaatttaatcagatcatgctgtttcctggagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtg

SEQ ID NO: 4668 - DNA, 645 bp, Homo sapiens
atgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgc

SEQ ID NO: 4669 - DNA, 808 bp, Homo sapiens
ctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctag

SEQ ID NO: 4670 - DNA, 1283 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctag

SEQ ID NO: 4671 - DNA, 1060 bp, Homo sapiens
aatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctag

SEQ ID NO: 4672 - DNA, 3529 bp, Homo sapiens
ctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggatttttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacacaaataat

SEQ ID NO: 4673 - DNA, 1973 bp, Homo sapiens
ggggcatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaggatgatggcagaggtagtcagacggaagctagggacccactatcagatcactaagaacagactgtaccgggaaaatgactgcatgttcccctcaaggtgtagcggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacacaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcgtaggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaa

SEQ ID NO: 4674 - DNA, 2620 bp, Homo sapiens
gcggctgcgctgctgggcgggggcgggagctggagccggagctggagccggggccggggcccgggtcagcgcttgagccgggagaagagtttgagatcgtggaccgaagccagctgcccggccaggcgacctgcggagcgcaacgaggccgcgggcggccgagggctggtcggcgcccatcctgaccctggcacgcagggccaccgggaacctgtcggcgagctgcgggagcgcgctgcgcgcggcgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaacttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcagaatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcattccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaaaaaaaaaa

SEQ ID NO: 4675 - DNA, 2118 bp, Homo sapiens
ctgggagaggcctctggagcaggaggcccagtggctcttctgacccaaggccccgccgtccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcgtctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcactctgg

SEQ ID NO: 4676 - DNA, 2523 bp, Homo sapiens
cgcatgggcccagggggcgggggtttgggtggctgccctcagtattgcctgcacaaatatctaccaagtctgcgacgaatagctccagcaactttgcaccgtgttttccagtaagcctaccgacaggcactgtgcagattcaagcagagagaagtccaagcactgaggccgctgctgcaccggccatcctgagaccctagtcgaccttccggcctccgcatccccgccccgcactaggacccctgcagacgatcaggcggcagccggggtgactttcttcctcttttggcaacatggcgggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaatttccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaaccaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttggaatttctctttaacaaccaaggggtttattttcaaagcgatattggggaattgatttcacagtttgttaccttagtaggtaacggtaaggttattctctctttttttttttggttatgaaaacttagggactacaattagtataaaaattggcataatgttggattgaatctacattttggcagaagttaagcattcccacataatgtcaaaattatacattatgcagtttttttgtttgttttattttgttttgtttttgagtctggctctgtcacctaggctggcatgtagtggcatgatctgcaatctctgcctcccaggttcaagcgattctcctgcctcagccccccaagtagctgagattacaggtgtgtgccaccacacggggctaatttttgtattagtagagacggggtttcggcatgttggccaggccagtctctcctgacctcagggtgatcagcccacctcggcctcacaaagtgccgggattacaggcgtgagccaccttgcctagcccacatcatgcagtttgaaatgaaactttgccacaaccagcctttgctgtagcacacacatatatcactgaaactgttcgaaataaagtttttttttgtttttcatgattcgtctttgagtacctccaggctgaaggactgttgtaccagtaaaaacttaaaggcacaaattatccttgaagaccttctcccttttctttggccccatattttatgttgctttatctttgaaattttgcatgaaaag

SEQ ID NO: 4677 - DNA, 1440 bp, Homo sapiens
atggcgggcggagaagctggagtgactctagggcagccgcatctttcgcgtcaggatctcaccaccttggatgttaccaagttgacgccactttcacatgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatac

SEQ ID NO: 4678 - DNA, 3922 bp, Homo sapiens
cgcacgggccggcggggcgggggtttggtggctgccctcagtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctttttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaactaattttatatctaacatgtccccatgtgttttgtaggtaccttctaccagaaattttggaataagacttaaaatatagacattgtaattaatctcatgtaagatttgaaaccagaattctattataattaatttcagacatccacatgaattagcaaatttgtaaagcactgtactgagtgtaatggg

SEQ ID NO: 4679 - DNA, 3922 bp, Homo sapiens; identical to SEQ ID NO: 4678

SEQ ID NO: 4680 - DNA, 3922 bp, Homo sapiens; identical to SEQ ID NO: 4678

SEQ ID NO: 4681 - DNA, 3335 bp, Homo sapiens
cctccttctcctcccagtgccacagagccgaagcccgagctgccgccgcagccacagccgagggcactatggtaagacgagcgcgctggccgggaggccgcggcgaggcgagaaaagccccccgcacggccccgggagtgaggccgccattttaacctgattttggcctccaaggtgggcgcttctgctctgcggctccgctgctctccagccgaccggcctgccctccggccgtcaggccctgccctgctgctctttggattttggggggcggggagggcccgggcgtcggcgcaggttgggggtcggggccgggcgggcgggggcgcgagagggtctgcggactgcagccgctcgcgccgcctttgcccttcgcttcctaattttacttaacacgcgaggctttaaaattggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaatttttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaa

SEQ ID NO: 4682 - DNA, 2767 bp, Homo sapiens
gctgacgggtgatgctcgggggctggaggcggctctgccaggctcccgggctccgctaccaccgcgtcgccccccccggcctgcagggctcgcgctctgaggtcaggccgaggacgcggacagccggggagccggggccgcgagacagaagggccggcctgggagcgggtggcgccggctggggaccaggcgtgcccacgtgaccgccccgcccgctgcctgcggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaatttttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatactta

SEQ ID NO: 4683 - DNA, 998 bp, Homo sapiens
ggcagatgagttagactccttcgctgtatcgtctactgattcttaaaatgtgacaaatctgattggacgacttacatggtacggtgcaatttttgatgtccagactaaagtgagtcttctctaggcaaacagtaattttggttaaaaccaaaatacgtgttctgaattactgttctgtgtttattttcaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctggtgtgtaaaaacaaaagaaaaaagtacttttaaaatgcaaggattattatcatagtcagtcttacctttgtttttcttataaatgggattcaataattttttttttttctgtagggctcctgaaagtgcacctttaaaaagcaagatgatttatgctagctctaaagatgccattaaaaagaaatttacaggtacaaacttgaatatttggggcagagaaattattctttattaattataataaagtaataggataatgttttttctttttaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggccc

SEQ ID NO: 4684 - DNA, 2767 bp, Homo sapiens; identical to SEQ ID NO: 4682

SEQ ID NO: 4685 - DNA, 2767 bp, Homo sapiens; identical to SEQ ID NO: 4682

SEQ ID NO: 4686 - DNA, 5635 bp, Homo sapiens
atggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctccaccaccaccacctccaccacctcctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcggaagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctgtggcttagggtgatacttttgccctccttgtgcccctctcagctttccatccccagctaggaagaaagaatggcactcttggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 4687 - DNA, 4950 bp, Homo sapiens
cggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccatctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaa

SEQ ID NO: 4688 - DNA, 5662 bp, Homo sapiens
ggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 4689 - DNA, 3296 bp, Homo sapiens
accttagcaagctacaaagtctttagattcccttagtattcatataataaaatcaaattttctaaactttgccacacaagatagttcccaggtcagcagtttcaacatcatttgggcacttgttagaaatgcacagtatcaggccctaccctacacttaaagaatcgggatctgtattttaaaagatgctcagctgattaatagccacgttaaacttttagaagcactgatctaatcccctaaatttcacatataaagaaacagagaccacccctcagaggagcaaacacagacatgctggatccggtcgtcactggatgggaacagggctcctaaagtttcgcactagaaggcaggcgatggacaggcgcaaaggggcctcacccggtcaaggagtaggatgcggccagcgcaggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagcctgggtggagcgaggcgcacatcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaacctgcttttctagtttttatattatttgcctctcatcacttctgcatagctcctgacagttacttcttaacagtgttctatgctggaagcctttatctaaactaaatacagggatgacctcttagcaatcttgccatcaatattatattcaagaaaataaaagttcggttatttgttgtttttgtttttcttcacataagcacatacttttgtcttgctacattatgtgattgattgttttgacctgattttttctgttgaatgacaatttctggcttgaatatggaatcctgcttcaggaataaacagaaaacaccgctaatttctatagttgaaggatatcattggcttctggttgtatgtgccatggctgaagtgttttttgctattagcattttcaagtttatccactgtttcttttacaggttaactaccctgtaaaattacttaaaaaaaaagtgttaaggcaatgtcatcaacataggctggcattttatgtgcatcctaaaatggaggattcctttccatgtaaacaaggtaaaagaataattattctgtaaaagtcagtttaatctgtttgtatatttgcctcatctatagaaggagctaaagcatacagatgacttaacacttcaaaatacattgatacagtttaattaattttgaagccaaaactagccaaactgtgtgc

SEQ ID NO: 4690 - DNA, 3296 bp, Homo sapiens; identical to SEQ ID NO: 4689

SEQ ID NO: 4691 - DNA, 1796 bp, Homo sapiens
ctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctggtaacataataatgtgtaataaagtct

SEQ ID NO: 4692 - DNA, 3351 bp, Homo sapiens
accttagcaagctacaaagtctttagattcccttagtattcatataataaaatcaaattttctaaactttgccacacaagatagttcccaggtcagcagtttcaacatcatttgggcacttgttagaaatgcacagtatcaggccctaccctacacttaaagaatcgggatctgtattttaaaagatgctcagctgattaatagccacgttaaacttttagaagcactgatctaatcccctaaatttcacatataaagaaacagagaccacccctcagaggagcaaacacagacatgctggatccggtcgtcactggatgggaacagggctcctaaagtttcgcactagaaggcaggcgatggacaggcgcaaaggggcctcacccggtcaaggagtaggatgcggccagcgcaggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagcctgggtggagcgaggcgcacatcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaacctgcttttctagtttttatattatttgcctctcatcacttctgcatagctcctgacagttacttcttaacagtgttctatgctggaagcctttatctaaactaaatacagggatgacctcttagcaatcttgccatcaatattatattcaagaaaataaaagttcggttatttgttgtttttgtttttcttcacataagcacatacttttgtcttgctacattatgtgattgattgttttgacctgattttttctgttgaatgacaatttctggcttgaatatggaatcctgcttcaggaataaacagaaaacaccgctaatttctatagttgaaggatatcattggcttctggttgtatgtgccatggctgaagtgttttttgctattagcattttcaagtttatccactgtttcttttacaggttaactaccctgtaaaattacttaaaaaaaaagtgttaaggcaatgtcatcaacataggctggcattttatgtgcatcctaaaatggaggattcctttccatgtaaacaaggtaaaagaataattattctgtaaaagtcagtttaatctgtttgtatatttgcctcatctatagaaggagctaaagcatacagatgacttaacacttcaaaatacattgatacagtttaattaattttgaagccaaaactagccaaactgtgtgc

SEQ ID NO: 4693 - DNA, 3296 bp, Homo sapiens; identical to SEQ ID NO: 4689

SEQ ID NO: 4694 - DNA, 1663 bp, Homo sapiens
ctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacag

SEQ ID NO: 4695 - DNA, 1391 bp, Homo sapiens
ctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacag

SEQ ID NO: 4696 - DNA, 831 bp, Homo sapiens
atgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtaccagagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtgg

SEQ ID NO: 4697 - DNA, 2331 bp, Homo sapiens
ggaatgatggcaaatttaaaatatgacaagcgggagtcacaggtacactgcaaaagtgaaacttagaagctttgtgagtcctgttgtaacgcttttgggcacatttatacatcatggggccaaagtcacattttttaccgattagattcctgatcattcaggggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgacttttcttctagaagagtccaggtggacagggagtccagttcagggacggagattcctggatgaaaagtgaagggagagggacagggcccatgccgagggtttcttcctggtttctcagacagctcctgggccaagactcagggaaacactgagacagagcgcttggcacaggaggagcggggtcagggcgaagtcccagggccccaggcgtggctctcagggtctcaggccccgaaggcggtgtatggattggggaggccccgccttggggattcgccacctccgcagtttctcttcttctcacaacctgcgacgggtcctttttcctggatactcaggaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgacccagacctgggcgcgctcccactccatgaggtatttctacaccaccatgtcccggcccggccgcggggagccccgcttcatctccgtcggctacgtggacgatacgcagttcgtgcggttcgacagcgacgccgcgagccagaggatggagccgcgggcgccgtggatggagcgggaggggccggagtattgggaccggaacacacagatctgcaaggcccaggcacagactgaacgagagaacctgcggatcgcgctccgctactacaaccagagcgagggcggttctcacaccatgcaggtgatgtatggctgcgacgtggggcccgacgggcgcttcctccgcgggtatgaacagcacgcctacgacggcaaggattacatcgctctgaacgaggacctgcgctcctggaccgcggcggacatggcagctcagatcaccaagcgcaagtgggaggcggcccgtcgggcggagcagctgagagcctacctggagggcgagttcgtggagtggctccgcagatacctggagaacgggaaggagacgctgcagcgcgcggacccccccaagacacatatgacccaccaccccatctctgaccatgaggccaccctgaggtgctgggccctgggcttctaccctgcggagatcacactgacctggcagcgggatggggaggaccagacccacacacggagctcgtggagaccaggcctgcaggggatggaaccttccagaagtgggcggctgtggtggtgccttctggagaggagcagagatacacctgccatgtgcagcatgagggtctgccagagcccctcaccctgagatgggagccatcttcccagcccaccatccccatcgtgggcatcgttgctggcctggttctacttgtagctgtggtcactggagctgtggtcgctgctgtaatgtggaggaagaagagctcagatagaaaaggagggagctactctcaggctgcaagcggcaacagtgcccagggctctgatgtgtctctcacagcgtgaaagtgtgagacagctgccttgtgtgggactgagaggcaagatttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggcggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacacatgagaaccttcca

SEQ ID NO: 4698 - DNA, 3328 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4699 - DNA, 3278 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4700 - DNA, 3126 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4701 - DNA, 3328 bp, Homo sapiens; identical to SEQ ID NO: 4698

SEQ ID NO: 4702 - DNA, 3328 bp, Homo sapiens; identical to SEQ ID NO: 4698

SEQ ID NO: 4703 - DNA, 3328 bp, Homo sapiens; identical to SEQ ID NO: 4698

SEQ ID NO: 4704 - DNA, 3236 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4705 - DNA, 3146 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4706 - DNA, 3235 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4707 - DNA, 3235 bp, Homo sapiens; identical to SEQ ID NO: 4706

SEQ ID NO: 4708 - DNA, 3199 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatgatgatgt

SEQ ID NO: 4709 - DNA, 2124 bp, Homo sapiens
gaattcggggataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagtaaagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgcccgaattc

SEQ ID NO: 4710 - DNA, 3191 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4711 - DNA, 3196 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4712 - DNA, 3235 bp, Homo sapiens; identical to SEQ ID NO: 4706

SEQ ID NO: 4713 - DNA, 3235 bp, Homo sapiens; identical to SEQ ID NO: 4706

SEQ ID NO: 4714 - DNA, 3328 bp, Homo sapiens; identical to SEQ ID NO: 4698

SEQ ID NO: 4715 - DNA, 3199 bp, Homo sapiens; identical to SEQ ID NO: 4708

SEQ ID NO: 4716 - DNA, 3329 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4717 - DNA, 3328 bp, Homo sapiens; identical to SEQ ID NO: 4698

SEQ ID NO: 4718 - DNA, 3284 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4719 - DNA, 3239 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 4720 - DNA, 1571 bp, Homo sapiens; identical to SEQ ID NO: 3774

SEQ ID NO: 4721 - DNA, 1591 bp, Homo sapiens
gtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaaaaaaaaaaaaaaaaaaaaaaaaaaaaa

SEQ ID NO: 4722 - DNA, 1874 bp, Homo sapiens
tcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactctttt

SEQ ID NO: 4723 - DNA, 2068 bp, Homo sapiens
attcagttggtctaaagtggggcctaacagttggaatttctaacaaattatccggtgatgctgatgctacaggtctgagtagcacatttggaaaatcacttcactagtacacccccgacgtgttgtcctgatggatccttccaaaaaattgttcagatgccaaggcttgtgaatcgcacacatggtactcaatgcctgggcctcacatcgaaggcttcttttattctgatcaccacgagtccattaaatttcaaaatgtgggacagccaatacataatatactactaagtaataaatctatgtcatccaaagggagctttgctgtcgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 4724 - DNA, 5702 bp, Homo sapiens
agtagaaaattaatttattaaaagaatggttggttatgcctcgcgtgagtgacagagccagggttttgtcttctatcttcagggcagggtacagctgggtattggaattgtaccaagcagtgtttcccaagggggcacagagggagggcccctctccgggcactgtgcgggagccacttccccaaacagtccccgttctgcaagggccccggcgttgctgcccccgagacccgggtgcctgccccggcggtgcgggtcgcgggcctccgctctcgccgtcctccctcagtcccgggcctcctgcatcgcggtcgccaggcgcaggctcagcgcggctgacagcgctccagctcccgcgctcgcggccgcctcaggcagccgaccgggttggggcggccccgcgctcggcccgggagccgatcccctgtgagggctcctccatctcctcccaccccgtgacctgctcgacgcgcaacagcccgagttgtctttaacttgctgcggcagcctctttgtcccgacccagggtcgggggcacctctcggcctggcccggccctgcccgtagccgtggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaatagttgtgccttacattggttttatttgaagttagagtggatccctgtttatcataattacttgtaattaggcagatgcttatcactctattataactcaaattgggaagaaaagaatgaaaaagaaaacaatggctgggtactggctcatacctgtaattttagcattttgggaaggtgagacgataggaccacttgagggcaggagtttgaggttgcagtgagctatgatggtgccactgcactccagcctgggcaacagagaagaaaccatgtatcttaaaaaaaaagaaaaaatgaaggatgaaaaagtgggattattatttaaccagtgaagaattcataaatgtgacaattaaggataatttgaatctcacaaatctattcaccccaccccagtcaaggtctattttaatatatctatcttcattggcattcttgagaaatagtgctgccattgaacattgggaatattcatccattctgcagatggaggacatcgtgcaggccatgtcctcattgctcccattctacatttagctgagaaacagaggttcctctttgtaaggatttgatgctcttctcatcttccaagaagtataccaagagcaaatttaactctatagttacctgttcttcaaagaaaaaagaaacttagaaggtagtgtttctgaggtcataactgtgaggggttgtatacaaagaatgagtcactttttaagccatttggaaaattagatctgtttctaattagatgacattttctccattctctgatttcctgaagattgccaagcatttgcttgataatctaccaggactgataattttgcagaatatgaggcaaatatatgaaattcagttgtgtatctatatcctagcaacaaacacttgaaaatataacgttaaaatatgccatttgtaatagcatcaaataagtcaaacttctaagtaggaagaaagttaacaacaagacctctactctgaaaactacaaaacagtgctgggaagaattatagagcaccaaaataaatggctattctatgctcatggattgaaagactgcataatggtaagatgtcagttccccacaaattgttatctagattcaatgagatcaaaatcccacaaggccatcttgtagaaattggcaaatacatatatgaaaatgcaacagattctaagtagccaagataattttgaagaagaaaaataaaattggagcacttgtactacccaatgtcaagacttgctctaaagctacaacagttaagagagtatggtac

SEQ ID NO: 4725 - DNA, 5702 bp, Homo sapiens; identical to SEQ ID NO: 4724

SEQ ID NO: 4726 - DNA, 2134 bp, Homo sapiens
gaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaaaaaaaaaaaaaa

SEQ ID NO: 4727 - DNA, 1802 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttc

SEQ ID NO: 4728 - DNA, 3730 bp, Homo sapiens
tcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 4729 - DNA, 3635 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 4730 - DNA, 2038 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagagacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatg

SEQ ID NO: 4731 - DNA, 3720 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 4732 - DNA, 2951 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccctgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccg

SEQ ID NO: 4733 - DNA, 3053 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 4734 - DNA, 2465 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaa

SEQ ID NO: 4735 - DNA, 2339 bp, Homo sapiens
ggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctgggtcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacaagcacaccttagaggctttgagagaaggccagctagttctgtcatgagtagtcggcctcgtgtctgtcctcccatcttggaacaaccttatcaacaggccgcactgcagaaatgatgttttatgaaaaccatgagctgctgccactccagcaagggaaataatgcagtttcctgtcttatttaagaaaaagagaaggctctcttttctcccttgtcattgccgttcttttccttacacgcaaaacatttttaactattgcagtttcatcccattctactgcttgattgaccatcaactccatcctatcgagattatttaagaatgaagaacataatttttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggcttgcgtgctgctagctgggttcaggcttcacccactggaaagaaccaccatctgctctaaccatgtagacttattgcggcctggttttctctgttacaataaaattactgtagaccc

SEQ ID NO: 4736 - DNA, 2417 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattcaaccaccatctgctctaaccatgtagacttattgcggcctggtttctctgttacaataaaattactgtagacccaa

SEQ ID NO: 4737 - DNA, 1575 bp, Homo sapiens
agctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcacctcccttccctcccacctttttggtacattggtgtaaaaaatgtaaaacaaaaaaattttatgaactaactgtggtgtgtgaaagagagaagaaaaactggaaatcttattccgtgtgtg

SEQ ID NO: 4738 - DNA, 1585 bp, Homo sapiens
ggggaagtggaagcgccgggccctgctgcgggggggagagccactgacgccgggaccgggaccgccgccgccgccctccacagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttcccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtta

SEQ ID NO: 4739 - DNA, 1768 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtta

SEQ ID NO: 4740 - DNA, 1997 bp, Homo sapiens
agctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtta

SEQ ID NO: 4741 - DNA, 928 bp, Homo sapiens
gacagggagtcagactggtcatgcaaggtggtccacaacatgacctctgagttcttcgctgcccagctccgggcccagatctctgacgacaccactcacccgatctcctactacaagcccgagttctacacgccagttgatgggggcactgctcacctgtctgtcgtcgcagaagacggcagtgctgtgtccaccaccagcaccatcaacctctactttggctccaaggtccgctccccggtcagcgggatcctgttcaatgatgaaatggacgacttcagctctcccaacatcaccaacgagtttggggtgccccctcacctgccaatttcatccagccagggaagcagccgctctcgtccatgtgcccgacgatcatggtgggccaggacggccaggtccggatggttgtgggagctgctgggggcacacagatcaccacagccactgcactgatatgtgtcacagcttttctccctggccgtgcccaccctgcacagcccccaagccacgctgatcacactcccatgccccaggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcatccactttcatcgctgtggtgcaagccatcgtccacacggctggtggctgggcagctgcctcggactccaggaaaggcggggagcctgctggctactgagtgctccaggcggacaaggctgacaagcaatctagggacaagatactcactaggaccaggaaggggactctgggggaccggcttcccctgtgagcagcagagcagcacaataaatgaggcactggagaggc

SEQ ID NO: 4742 - DNA, 1126 bp, Homo sapiens
agagctgggctctgcgtcctcgtccagccgccaactcggccaaaggcgaagccagcagtttcttctgctgccgggcaacgcgccttttaaacctgagggagtgggcgcgtgagcacttaatggcgcccgtgacagagtgagcttaacggattaataagcgcagccaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggtatgtgtcacaccttttctccctggccgtgcccaccctgcacagcccccaagccatgctgatcacactcccatgccccaggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 4743 - DNA, 1126 bp, Homo sapiens; identical to SEQ ID NO: 4742

SEQ ID NO: 4744 - DNA, 1049 bp, Homo sapiens
ctcgagagctgggctctgcgtcctcgtccagccgccaactcggccaaaggcgaagccagcagtttcttctgctgccgggcaacgcgccttttaaacctgagggagtgggcgcgtgagcacttaatggcgccggtgacagagtgagcttaacggattaataagcgcagccaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 4745 - DNA, 1126 bp, Homo sapiens; identical to SEQ ID NO: 4742

SEQ ID NO: 4746 - DNA, 883 bp, Homo sapiens
gacagggagtcagactggtcatgcaaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 4747 - DNA, 883 bp, Homo sapiens; identical to SEQ ID NO: 4746

SEQ ID NO: 4748 - DNA, 883 bp, Homo sapiens; identical to SEQ ID NO: 4746

SEQ ID NO: 4749 - DNA, 883 bp, Homo sapiens; identical to SEQ ID NO: 4746

SEQ ID NO: 4750 - DNA, 5463 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 4751 - DNA, 5476 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 4752 - DNA, 5346 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 4753 - DNA, 1268 bp, Homo sapiens
tagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaa

SEQ ID NO: 4754 - DNA, 1506 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatgtaagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaat

SEQ ID NO: 4755 - DNA, 1691 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggctatttccttctaggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatgtaagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaat

SEQ ID NO: 4756 - DNA, 1268 bp, Homo sapiens; identical to SEQ ID NO: 4753

SEQ ID NO: 4757 - DNA, 1688 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaat

SEQ ID NO: 4758 - DNA, 1598 bp, Homo sapiens
gaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgattttttttttttttttggtagagacaggtctcactatgttgcgctggctggtctcaaacttccagacccaagcatcctcctgccttggcctcctaaagtattgggattacaggcatgagcctctgcacccagctgacttcttcctttattatttatttattttgagacggagtttcactcttgttgcccaggctggagtgcagtggcgcgatctcggctcaccacaacttccgcctcctggcttcaagagattctcctgccttgggccgggcgcggtggctcacgcctgtaatcccagcactttgggaggccgag

SEQ ID NO: 4759 - DNA, 833 bp, Homo sapiens
gaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctctttggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttaataaaag

SEQ ID NO: 4760 - DNA, 1429 bp, Homo sapiens
ggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 4761 - DNA, 957 bp, Homo sapiens
gggggtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttgtctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctaaaaaaaaaaaaaaaaaa

SEQ ID NO: 4762 - DNA, 1958 bp, Homo sapiens
tggggttctgagcgagtcgtgcgttttaggtttagtgtcttttccttgtccctgctcggggagcgtgaggcagatcggccggctttgctccaggcctcaggagtgtaagtttaagggcgcgaacctgggtgggacggggcagtttttccagcgggccatacgggaaaatttttggttcgaggaagacaaccaccctttttaaggagaaaactgcatcttgccctgccttattcctacgcggtgcccaggtggggtgtgtgtggaccagtcaatgaccgcccaagctctccgagtagaaaacccaaacatggttttgtggggtgtgtgcctttgaccccggacttaagcaacaagcgtggtcttgggcgtagctacgaggtggttggtgggctccagggcctgcgtgcccctcgacgtgagcgatgattggcggtgcaggataacagatcgccttcttggccactcagtggcaggggacttgctacttccgggtcggcggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 4763 - DNA, 2443 bp, Homo sapiens
agcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcatagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 4764 - DNA, 2443 bp, Homo sapiens; identical to SEQ ID NO: 4763

SEQ ID NO: 4765 - DNA, 2443 bp, Homo sapiens; identical to SEQ ID NO: 4763

SEQ ID NO: 4766 - DNA, 953 bp, Homo sapiens
cgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatataaaaaaaaaaaaaaaaaaaaaaaaaaaaaaaaaaaaaaaaaaaaaaaaaa

SEQ ID NO: 4767 - DNA, 7644 bp, Homo sapiens
ccctgcggctgagaacgggcgatgcgggtgttgctgtgacccctggaatgcaaaggactgcacccccatcagaaagttagaaagccagtgcagagtagccaggagtcctgttcactcggcaggagcaggggtgccgagtggggggatctctggtcccgcagctcggccgccaccaagagcccgaagtgctgggcgcggtgccaccagaggcccgccacgccccacgccgccctgcaggcgaacgctggaggccccgccgggccgccgtagcgctgcggctcgggccgctcctcccgcgccgccctccgcccccagcctcccggcgccgcggcagctctgggcagggagcgccgccgccgccgccgccgccgccgcttcctcgtctgcagccgttcggccgctgcgtgacgcgtcgtttcctcccaacatggcggccggggcaggtcggcggtgatgggggccagttcgcggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagt

SEQ ID NO: 4768 - DNA, 7212 bp, Homo sapiens
gcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatc

SEQ ID NO: 4769 - DNA, 7644 bp, Homo sapiens; identical to SEQ ID NO: 4767

SEQ ID NO: 4770 - DNA, 8848 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatgtgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaa

SEQ ID NO: 4771 - DNA, 8848 bp, Homo sapiens; identical to SEQ ID NO: 4770

SEQ ID NO: 4772 - DNA, 5860 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagaagactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacaaaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtgaataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggctggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataagtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagcc

SEQ ID NO: 4773 - DNA, 6487 bp, Homo sapiens
cgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttag

SEQ ID NO: 4774 - DNA, 6572 bp, Homo sapiens
cgcagacccgcggagtttcccgtgccgacgccccggggccacttccagtgcggagtagcggaggcgtgggggcctcgaggggctggcgcggtccagcggtcgggccagggtcgtgccgccggcgggtcgggccggacaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctccttttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctgctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctg

SEQ ID NO: 4775 - DNA, 6343 bp, Homo sapiens
gcggccgcactggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttag

SEQ ID NO: 4776 - DNA, 6287 bp, Homo sapiens
gcggccgcactggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctg

SEQ ID NO: 4777 - DNA, 6209 bp, Homo sapiens
gcggccgcactggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctg

SEQ ID NO: 4778 - DNA, 6474 bp, Homo sapiens
gggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctccttttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctg

SEQ ID NO: 4779 - DNA, 6544 bp, Homo sapiens
cgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttag

SEQ ID NO: 4780 - DNA, 6622 bp, Homo sapiens
cgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttag

SEQ ID NO: 4781 - DNA, 6287 bp, Homo sapiens; identical to SEQ ID NO: 4776

SEQ ID NO: 4782 - DNA, 6343 bp, Homo sapiens; identical to SEQ ID NO: 4775

SEQ ID NO: 4783 - DNA, 1402 bp, Homo sapiens
ctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttca

SEQ ID NO: 4784 - DNA, 1795 bp, Homo sapiens
cggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcacatttcacccctccctttctcccctgcccccaggactgggccacttctgggtggggcagtgggtcccagattg

SEQ ID NO: 4785 - DNA, 1904 bp, Homo sapiens
cggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 4786 - DNA, 1795 bp, Homo sapiens; identical to SEQ ID NO: 4784

SEQ ID NO: 4787 - DNA, 1982 bp, Homo sapiens
gaagccagggggactgcgcgcgtgagcgtcacgcatgcggggtcaacggatgggtgcttggtgctctgggcactgcaggggtgctggctggactgcggttaccgcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcacttttttagccacagtattgctccctaaaatatgcataaagtagaaattcactgccttcccctcctgtccatgaccttgggcacaggga

SEQ ID NO: 4788 - DNA, 1982 bp, Homo sapiens; identical to SEQ ID NO: 4787

SEQ ID NO: 4789 - DNA, 1982 bp, Homo sapiens; identical to SEQ ID NO: 4787

SEQ ID NO: 4790 - DNA, 2339 bp, Homo sapiens
cctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccaaaaaaaaaaa

SEQ ID NO: 4791 - DNA, 2293 bp, Homo sapiens
gaagccagggggactgcgcgcgtgagcgtcacgcatgcggggtcaacggatgggtgcttggtgctctgggcactgcaggggtgctggctggactgcggttaccgcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccatt

SEQ ID NO: 4792 - DNA, 5056 bp, Homo sapiens
gggctcggcagggcgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactg

SEQ ID NO: 4793 - DNA, 5056 bp, Homo sapiens; identical to SEQ ID NO: 4792

SEQ ID NO: 4794 - DNA, 5176 bp, Homo sapiens
ctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtcccccggtctcccgattcccaactgagtgttatttgcacactgcactgttttcaaataacgattttatgaaatgacctctgtcctccctctgatttttcatattttcctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtaaaaaaaaaaaaaaaaaaa

SEQ ID NO: 4795 - DNA, 5056 bp, Homo sapiens; identical to SEQ ID NO: 4792

SEQ ID NO: 4796 - DNA, 5325 bp, Homo sapiens
ctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctaccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggcggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtcccccggtctcccgattcccaactgagtgttatttgcacactgcactgttttcaaataacgattttatgaaatgacctctgtcctccctctgatttttcatattttcctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtaaaaaaaaaaaaaaaaaaa

SEQ ID NO: 4797 - DNA, 5056 bp, Homo sapiens; identical to SEQ ID NO: 4792

SEQ ID NO: 4798 - DNA, 5208 bp, Homo sapiens
gggctcggcagggcgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagt

SEQ ID NO: 4799 - DNA, 4898 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 4800 - DNA, 4859 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 4801 - DNA, 4177 bp, Homo sapiens
gttctctctctctttctctcttcttccttttttttttcccccaaaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 4802 - DNA, 2539 bp, Homo sapiens
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 4803 - DNA, 3373 bp, Homo sapiens; identical to SEQ ID NO: 4037

SEQ ID NO: 4804 - DNA, 3373 bp, Homo sapiens; identical to SEQ ID NO: 4037

SEQ ID NO: 4805 - DNA, 1635 bp, Homo sapiens; identical to SEQ ID NO: 3225

SEQ ID NO: 4806 - DNA, 1422 bp, Homo sapiens
ggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 4807 - DNA, 1268 bp, Homo sapiens
ggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 4808 - DNA, 1182 bp, Homo sapiens
ggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaagttagaactctcatcacatgttcgactcaaattgtggagcaaaagagtaaataagatataaaaatgaaaatgaagatacgtg

SEQ ID NO: 4809 - DNA, 1081 bp, Homo sapiens
cacccaggtagtgagctaaatacctactaaataggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaagttagaactctcatcacatgttcgactcaaattgtggagcaaaagagtaaataagatataaaaatgaaaatgaagatacgtg

SEQ ID NO: 4810 - DNA, 591 bp, Homo sapiens
ggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaaggtgagtacattttcttcctcctcctcctactgtcctccccatcctcccactcttcctctttctctattctatctttaatttataagaccagaggaggaaggcactatcatgttataaaactgaattctgagttaggacaggatttgattactaactaaccatgtcagcttgagtgtattacttcacctcttagatttaattttttttgttcaa

SEQ ID NO: 4811 - DNA, 9535 bp, Homo sapiens
ccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcaaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactagcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctgagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccgccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagaccgaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaactc

SEQ ID NO: 4812 - DNA, 1378 bp, Homo sapiens
gcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaaaaaaaaaaaaaaaaaa

SEQ ID NO: 4813 - DNA, 2375 bp, Homo sapiens; identical to SEQ ID NO: 3375

SEQ ID NO: 4814 - DNA, 684 bp, Homo sapiens
atgagagacgttcttcgccgagagtcgtaggggtttcctgcttcaacagggcttggacggaacccggcgctcgtcccccaccccggccggccgcccatagccagccctccgtcacctcttcacggcgccctgggactgccccaaggctcccgccggctgctccagcgcggcgcagccactgccgccgccgccgcctctccttagtcgccgcaatgacgaccgcgtccacctcgcaggtgcgccagaactaccaccagtactcagaggccgccatcaaccgccagatcaacctggagcactacgcctcctaagtttacctgtccctgtcttactactttgaccgcgatgatgtggctttgaagaactttgccaaatactttcttcaccaatctcatgaggagaggggacatgctgagaaactgatgaagctgcagaaccaatgaggtggccgaatcttccttcaggatatcaagaaaccagactgtgatgactgggagagcgggctgaatgcgatggagtgtgcattacatttggaaaaaaatgtgaatcagtcactactggaactgcacaaactggccactgacaaaaatgacccccatttgtgtgacttgagatacattacctgaatgagcaggtgaaagccatcaaagaattgggtgaccacgtgaccaacttgcgcaagat

SEQ ID NO: 4815 - DNA, 620 bp, Homo sapiens
cgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttctttgatttgtaccattccttcaaataaagaaatttggtacccag

SEQ ID NO: 4816 - DNA, 684 bp, Homo sapiens; identical to SEQ ID NO: 4814

SEQ ID NO: 4817 - DNA, 756 bp, Homo sapiens
gccgagagtcgtcggggtttcctgcttcaacagtgcttggacggaacccggcgctcgttccccaccccggccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaa

SEQ ID NO: 4818 - DNA, 3541 bp, Homo sapiens
ctgcaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgcggggacctgctggggtgtgagggcagagggagggttgccatgaaggaacttgggattttcaatggaataaataaaacataaagtctatacttgggaatga

SEQ ID NO: 4819 - DNA, 3541 bp, Homo sapiens; identical to SEQ ID NO: 4818

SEQ ID NO: 4820 - DNA, 3994 bp, Homo sapiens
gcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgcagccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaaaaaaaaaaaaaaaaaaaaaaaaaaaaaaaaaaaaaaaaaaaaaaaaaa

SEQ ID NO: 4821 - DNA, 3555 bp, Homo sapiens
caggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgcggggacctgctggggtgtgagggcagagggagggttgccatgaaggaacttgggattttcaatggaataaataaaacataaagtctatacttgggaatga

SEQ ID NO: 4822 - DNA, 3700 bp, Homo sapiens
ctgcaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaa

SEQ ID NO: 4823 - DNA, 981 bp, Homo sapiens
atgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtct

SEQ ID NO: 4824 - DNA, 2404 bp, Homo sapiens
cgctgcggcgcttctggctccagaccgccctccggatcggaccctgcgaatggttttggctatatcttcatgtaggacctactccctatcccgtcggccgcggtgaatcccacctgcggtgctttaacttgtgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacatttgtcttacggctcagtggtaaggtagctgtagagacacattacggggtaaatggaaaagggaaataaaggggaagcccaggcacatgggtgcagggaggggtggggaataccacttccactttcttttgtctttttctttaaaaaaaaaaaaaaaaaggcaggggtgtgat

SEQ ID NO: 4825 - DNA, 2359 bp, Homo sapiens
cgagttaccgcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacatttgtcttacggctcagtggtaaggtagctgtagagacacattacggggtaaatggaaaagggaaataaaggggaagcccaggcacatgggtgcagggaggggtggggaataccacttccactttcttttgtctttttctttaaaaaaaaaaaaaaaaaggcaggggtgtgat

SEQ ID NO: 4826 - DNA, 2404 bp, Homo sapiens; identical to SEQ ID NO: 4824

SEQ ID NO: 4827 - DNA, 2343 bp, Homo sapiens
ccggatcggaccctgcgaatggttttggctatatcttcatgtaggacctactccctatcccgtcggccgcggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacatttgtcttacggctcagtggtaaggtagctgtagagacacattacggggtaaatggaaaagggaaataaaggggaagcccaggcacatgggtgcagggaggggtggggaataccacttccactttcttttgtctttttctttaaaaaaaaaaaaaaaaaggcaggggtgtgat

SEQ ID NO: 4828 - DNA, 1527 bp, Homo sapiens
ccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtc

SEQ ID NO: 4829 - DNA, 1145 bp, Homo sapiens
ggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaaaaaaaa

SEQ ID NO: 4830 - DNA, 1527 bp, Homo sapiens; identical to SEQ ID NO: 4828

SEQ ID NO: 4831 - DNA, 1527 bp, Homo sapiens; identical to SEQ ID NO: 4828

SEQ ID NO: 4832 - DNA, 1251 bp, Homo sapiens
ttatcagttgttgagagaggggtgttaaagtctgtgattaaaattgtggatttgcacagcccaaactgcaagttgcttattatttgaaatccagtggatatcttgacctacgtggcttggaagataagtggctttcccaaaaaccgtgttattggaagtggttgcaacctggattcggcccgattccattacccgacggggaaagactgggagttcacctattaagctgtcatgggtgggtccttggggaacatggagattccagtgtgcctgtatggagtggagtgaatgttgcttgtgtcttcctgaagattctgcacccagatttaggcactgatacagataagaaacagtggaaagaggttcacaagcaggtggttgagaatgcttacgaggtgatcaaactcaaaggctacacatcctgggccattggactctgtagcagatttggtagagagtataatgaagaatcttaggcaggtgcacccaattcccaccatgattaagggtctctatggaataaaggatgatgtcttccttagtgttccttgcattttgggacagaatggaatctcagaccttgtgaaggtgactctgactcctgaggaagaggcccgtttgaagaagcgtgcagacacactttgggggatccgaaaagagctgcaattttaaagtcttctgatgtcatagcatttcactgtctatgctacaacaggactttagttggaggttgtgcctgatatcctttttatctgatctgtgattaaagcagtaatattttaagatggactgggaaaaacatcaattcctgaagttagaaataggaatggtttgtaaaatccacagctatatcctgatgctggatggtactaatttgtgtagtcctaaactggtttgtgtgaaatagttctgccacctctgaggcaccactgccaatgctgtacatgctgcatttgccccttgagccaggtggatgtttaccatgtgatatataacttcctggctccttcactgaacatgcctagtccaacattttttcccaatcagtcacatcctgggatccagtgtacaaatccaatatcgcatgtcttgtgcataattgttccaaaggatcttattttgtgaactatatatatcagtagtgtacattaccatataatgtaaaaagatctacatataaacaatgcaaccaactatccaagtgttataccaactaaaccccccaataaaccttgaacagtgaaaaaaatt

SEQ ID NO: 4833 - DNA, 8342 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaagggggaaaaaaaaaaacatacagcacgaagataggaagtctgcagaatgcggccagagctgaaagaggatgacttcactgaagaggcagcatttcaaccaggcttgagcgttcccctgctggggcggtgaggaagacgggactaaatgagcagagacatgggagtgggagctgtctgggaaaagcaagaatagttgggaggcttccagaaagtcatgtgggaaatgcaggtagggccctggagtgcaaggctaaggcatcaacagtcttggtggtttctgagcagtagagcagtgtgaggagtaggacgttaggaaggctaatggataggtggagagagaatggcaggaggaggaggcattataaggaggctgtgattttctaggtaggtgggaatggagtttgaatttggtgagagaagggacccaaagcagagaaggagggggtgtgttgcgcatccacgcagcctacaggcagtcagggactgttcactccaggtagacaggtaggacccaagctctggtcaaggttgtgctgctgctggccctgtgctgagtcttaaccctgctgctgtggactgctgtgg

SEQ ID NO: 4834 - DNA, 8342 bp, Homo sapiens; identical to SEQ ID NO: 4833

SEQ ID NO: 4835 - DNA, 6980 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 4836 - DNA, 6938 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 4837 - DNA, 6992 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagacataaagcactcatgacaattatacctgatttgtcccccaacaaccctctgagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 4838 - DNA, 4844 bp, Homo sapiens
catggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccag

SEQ ID NO: 4839 - DNA, 4844 bp, Homo sapiens; identical to SEQ ID NO: 4838

SEQ ID NO: 4840 - DNA, 15325 bp, Homo sapiens; identical to SEQ ID NO: 4361

SEQ ID NO: 4841 - DNA, 2563 bp, Homo sapiens
attggtggatccatttagttcaagaaaatggagaccgaacagccagaagaaaccttccctaacaccgaaaccaatggtgaatttggtaaacgccctgcagaagatatggaagaggaacaagcctttaaaagatctagaaatactgatgagatggttgaattgcgcattttgcttcagagcaagaatgctggggcagtgattggaaaaggaggcaagaatattaaggctctccgtacagactacaatgccagtgtttcagtcccagacagcagtggccccgagcgcatactgagtatcagtgctgatattgagacgattggagaaattctgaagaaaatcatccctactttggaagagggcctgcagttgccatcacccactgcaaccagccagctcccgctcgaatctgatgctgtggaatgcttaaattaccagcattataaagggagtgacttcgactgcgagctgagactgttgattcatcaaagtctggccggaggaattattggtgttaaaggtgctaaaatcaaagaacttcgagaaaacactcagacaacaatcaagcttttccaggaatgctgccctcattctactgacagagttgttcttattggaggaaagcccgatagggttgtagaatgcatcaagatcatccttgaccttatatctgagtctcccatcaaaggacgtgcacaaccttatgatcccaacttctatgatgaaacctatgattatggtggttttacaatgatgtttgatgaccgccgaggacgacctgtgggattccccatgcggggaagaggtggttttgacagaatgcctcctggtcggggtgggcgtcccatgcctccttctagaagagattatgatgatatgagccctcgtcgaggaccaccaccaccaccacctggtcgaggtggacggggtggcagcagagctcggaatcttcctcttcctccaccaccaccacccagagggggagatctcatggcttacgacagaagaggacggcctggagaccgctatgatggcatggttgggttcagtgctgatgaaacttgggactctgcaattgacacatggagcccatcagaatggcaaatggcttatgaaccacagggtggttctggatatgattattcttatgcagggggccgtggctcgtatggtgatcttggcggacctattatcactacacaagtaactattcccaaagatttggctggatctattattggcaaaggtggtcagcggattaaacaaattcgtcatgagtctggagcatctatcaaaattgatgaacctttagaaggatctgaagatcggatcattaccattacgggaacacaggaccagatacagaacgcacagtatttgctgcagaacagtgtgaagcagtattctggaaagtttttctaagactagtgaagaactgaaggagtcctgcatctttttttttttatctgcttctgtttaaaaagccaacattcctctgcttcctaggtgttctgcatttgaggtgtagtgaaatctttgctgttcaccagatgtaatgttttagttccttacaaacagggttggggggagggcatgcaaaaaaactaacattgaaattttgaaacagcagcagagtgagtgacttttattttttgttcattgttggtggttttaaaaattccccccgtgtaattattgtgaacaccttgctttgtggtcactgtaacattggggggtgggacagggaggaaagtaatagtccacatgtccctggcatttgttcagagcagtgtgcagaatgtaatgctcttttgtaagaaacgttttatgatttttaaaataaatttagtgaatctatttttggtggtctttttttttttttttaaagacaatttcaaatggtggttgaattttccagcccacccctaaactaaacactaagtttgattttcagcagctcctctgttggatataagtgcacctcttggatatagacaaacacattggcaaatttcagtttgggtgatttcttaatggttggaaagacttggcttgataaatttccatcacatattcatgcttataataagcttgggattttgtttgtttttgcaaatgtttgccactacttttcaacagttttctgttagtcgtggggaactgcggtggggagcaatactacaagagtaagcatctgagtatgtgccagaagcctggtgggcaatgagctttattaaccagagtaacacttggttatggaagtggctgatgctgaataaatcctggttatttttgttagataatttctcacctatagacttaagctgtcaactgctagcgtcttgttagttgaactttgtaaaaatatatatatacttgtttttccattgtatgcacaatgaaagaaaaaagatgtaccatttctctgttgtgtgttgaattatgtaggaaatgtttgtgaacgattcaaaaaaaatggaaaagttcctgtggatgttttgtgtagtaacttggcatctgtattgatagttccaaatccacatctaaataaaacttcatgatgtta

SEQ ID NO: 4842 - DNA, 2911 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacaggttgagtatcatagttattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgtattt

SEQ ID NO: 4843 - DNA, 2899 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagtaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacaggttgagtatcatagttattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgtattt

SEQ ID NO: 4844 - DNA, 2911 bp, Homo sapiens; identical to SEQ ID NO: 4842

SEQ ID NO: 4845 - DNA, 2865 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaactgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgta

SEQ ID NO: 4846 - DNA, 1904 bp, Homo sapiens
tgcgcgaacgagaaaggaggagggcgctccaggcgaaagcactgcggacgccattatcctctgtttctcagctgctgcaacctcgacgtctcgcctacgtcccgcttctttgcggcctataggctactgcagcactagggtgtcagttggtcccgcccagaacacttcagttctgctctgcaaggatatataatacctgattggtgtgtccatttgatacacgaaaatggaaactgaacagccagaggaaaccttccccaacaccgaaaccaatggtgaatttggtaaacgccctgcagaagatatggaagaggaacaagcttttaaaagatctagaaacactgatgagatggttgaactacgcattttgcttcagagcaagaatgctggggcagtgattggaaaaggaggcaagaatattaaggctctccgtacagactacaatgccagtgtttcagtcccagacagcagtggccccgagcgcatattgagtatcagtgctgatattgagacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgagactgttgattcatcagagtctggcaggaggaattattggggtcaaaggtgctaaaatcaaaaaatttggggggaacacacagacaacaatcaagcttttccaggaatgctgtcctcattccactgacagagttgttcttattggaggaaaacctgatagggtggtagagtgcatcaagatcatccttgatcttatatcagagtctcccatcaaaggacgtgcacagccttatgatcccaatttttatgatgaaacctacgattatggtggctttacaatgatgtttgatgaccgccgtggacgccctgtgggatttcccatgcgggggagaggtggttttgacagaatgcctcctggtcggggtgggcgtcctatgcctccatccagaagagattatgacgatatgagccctcgccgaggacctcctcctccacctcctggaagaggtggccggggtggtagtagagctcggaatcttcctcttcctcctccaccaccacctagaggaggggatctcatggcctatgacagaagaggaagacctggagaccgctacgatggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaagcaaatccgtcatgagtcaggagcttcgatcaaaattgatgaacctctagaagggtctgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggtgggcgggggaagggcgtgcaaaaactaacattgaaattttgaaacagcagcagagtgattgtatttt

SEQ ID NO: 4847 - DNA, 2908 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacaggttgagtatcataattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgtattt

SEQ ID NO: 4848 - DNA, 2971 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacaggttgagtatcatagttattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgtattt

SEQ ID NO: 4849 - DNA, 2823 bp, Homo sapiens
ccctccccccagctagtgagtgcgcgaacgagaaaggaggagggcgctccaggcgacagcattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacatagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccaatttgaacaagggttgattgacacctgtaaaatttgttgaaacgttcctcttaaaaggaaatatagtaatcttatgta

SEQ ID NO: 4850 - DNA, 3904 bp, Homo sapiens
gcggctgggttcccagagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaactcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctcttcagcgagtcccgcgagcacctggctagacagttaacaagcacgtccttccagcctgagccagcgcaggtttgggagggggcttcctggccccccccacggtgttccagcccctctctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccg

SEQ ID NO: 4851 - DNA, 3292 bp, Homo sapiens
tctcccccctcgtcgtcctcccagcggctgggttcccagagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaga

SEQ ID NO: 4852 - DNA, 9182 bp, Homo sapiens
aattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttaatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagt

SEQ ID NO: 4853 - DNA, 9847 bp, Homo sapiens
accagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgcctgtaatcagagagcctgccacccccgctgtgccgagcacgggacctgcaaggatggcaagtgtgaatgcagccagggctggaatggagagcactgcactatcggtaggcttactgcaaagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcac

SEQ ID NO: 4854 - DNA, 9826 bp, Homo sapiens
accagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgcctgtaatcagagagcctgccacccccgctgtgccgagcacgggacctgcaaggatggcaagtgtgaatgcagccagggctggaatggagagcactgcactatcggtaggcttactgcaaagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcac

SEQ ID NO: 4855 - DNA, 10326 bp, Homo sapiens
accagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgctcactatttggataagatagttaaagagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttaatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagt

SEQ ID NO: 4856 - DNA, 8839 bp, Homo sapiens
atgcagagttccatgaataggccttacatttgcttggaactgggggccgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcagctgtgttgatgtaaaagagcgccctgctcgtccgcttgctgcagccgcccggtctgcagggtccgcggcggcggggagggattctggcgtcctagcgcttctgcaggcccgggtttgggggtggccgctcaggtcagggctaggacccagcactggctttgctggacaggccatcggactgcctcctgggaggtccccaagccaggccacaggcggtcctgctgcaggggtcctaggaggccccgggtgctctgcggaccataaaaataccatggccatgaaaggagctcgcccgccagtgacctgggtcagccaggggctcaggggcggcttccctatggcactcggtgccgccgcaggagctgctgttggaagtggaacctactgctatgtgtttaaaggaaaaataattcatttaataactacaaagagggttttcatgggaccaaagactaaggtaagggactacgtcgttggccatgggcctgcaaacctgtcgctacctgagttttgcgtgtttctctacacgcagctttgccagaatgccactcacgaagcagaaggcaggcttctctccctgggccctgttgctcctctgctgttaccagctcccctcaggttctccacctgctcccagcgtggacatgttcccctttctggagggaagccctttctcccctcacaccatttttctccccagtccactctatttcactcagcagtctgggctttagaaaaccggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtcagtgccgttactttatgtattggatctgaagggctttttgacagtggtagtcatcacactgccttcttattcttcctccattgcgctggtaaattccagtacatacacaatgcatctctttggcctcaactggcagctacagcagactgaaaatgacacatttgagaatggaaaagtgaattctgataccatgccaacaaacactgtgtcattaccttctggagacaatgtaaaacctacagacaaccttagtgtttcctatgatcattcccaggttcaggctctagggctttatggaggtagtgatctcagaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttt

SEQ ID NO: 4857 - DNA, 10326 bp, Homo sapiens; identical to SEQ ID NO: 4855

SEQ ID NO: 4858 - DNA, 2890 bp, Homo sapiens
tgggtcggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttg

SEQ ID NO: 4859 - DNA, 2978 bp, Homo sapiens
ggcggcgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgtccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaaaaaaaaaaaaaaaaaaaaaaaaaaa

SEQ ID NO: 4860 - DNA, 3700 bp, Homo sapiens; identical to SEQ ID NO: 4822

SEQ ID NO: 4861 - DNA, 879 bp, Homo sapiens
ctgcaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgg

SEQ ID NO: 4862 - DNA, 7848 bp, Homo sapiens; identical to SEQ ID NO: 3625

SEQ ID NO: 4863 - DNA, 7959 bp, Homo sapiens; identical to SEQ ID NO: 3615

SEQ ID NO: 4864 - DNA, 7935 bp, Homo sapiens; identical to SEQ ID NO: 3631

SEQ ID NO: 4865 - DNA, 8226 bp, Homo sapiens; identical to SEQ ID NO: 3632

SEQ ID NO: 4866 - DNA, 8013 bp, Homo sapiens; identical to SEQ ID NO: 3623

SEQ ID NO: 4867 - DNA, 7823 bp, Homo sapiens; identical to SEQ ID NO: 3620

SEQ ID NO: 4868 - DNA, 7935 bp, Homo sapiens; identical to SEQ ID NO: 3631

SEQ ID NO: 4869 - DNA, 4663 bp, Homo sapiens
cctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 4870 - DNA, 4673 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtcctctcctttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 4871 - DNA, 2505 bp, Homo sapiens
ccccggggtttggagcgcgcgtgggagcgcaataacggtggcggggaacgggtccaatcccggcggctcctggggttcccaagcgcgctgccactcagtccccgagctcggggaggcgtctcccggcttcggtcccgttcagcttaagctggcgtcacatgagccgcgggggaacgggcaccgcgggagtgggcgggggtgtgcgcgccgggagggggccgcccagtccacctatatgcgccgcagcccggctgacggatgccaggaattcccaatgagaggcgatggggggaagtttgggcaactcggcctggccaatggagagcctcgggagggctctgccccttccccccgcccccgcccgcctcggctcccgcagcgatagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggtacccggggccccctgctccttccatgcccagcacacctcctgctggaccccaaaccatgtcctcctgcccgcctccacctctcctggtgacaggtatctggatggtctggtctctcggacagaggcagtccctagttctgaagtggcgtgttgttcttacctggctcccgtcccaccccacacctctctctctcatcttctactgttaacaagaaaattgggcagcagctcactttctgggacccagatgactggcttaagcaggaagggctgtgtgcatgaggcagccggggtggttctggaaggctactgaaaggtgaacaggagcagcccttccatgcccacgtctgttgaagccactggctcgatagagcagctggagctcccttagaagggcaatgctgggagacacctccagtcttcacttacccacttggcaaaggcatcataaagccccacctttgtcctgctcatgggcatgacttagcagatctgtcctcagccccttgggctctagtgccttctcctgtatcctgcctgggactcccatgcggccatgctgcactctgtgttctcagacataagcagaacctctgggaggaagggagaggcggtgggcagctgtgagccccgtcaagtgtcctggcccagttttgctccgggaggcctgagattaaagttcagtcgtgcaggttctgcaccacacaggggttccacgactaaagggcactgtccatgctgtggacattgaagatttgaacattttcatcaccaggcttaggcagcatacacccctcccccagacctccctggtaggcaggactccagaagaagcacaacatcaccatgaccacagaatcttcacgtctcatgcagatctcctgccctccacatggcatctgagtgaccgttttaaaatgcatgatgaggccgggctggtggctcacgcctgtaatcccagcactttgggaggccaaggcaggcggatcacttgaggccaggagttcgagaccagcctggccaacatggtgaaaccccgtctctactaaaaatacaaaaattagccgggtgtgatagcaccctcctgtaatcccagctattcaggaggctgagaccagagaatcgcttgaacccgagaggtggaggttgcagtgagccaagattgtgccactgcactccagcctgggtgacagagtcagactctgtctc

SEQ ID NO: 4872 - DNA, 4243 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 4873 - DNA, 4249 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 4874 - DNA, 4243 bp, Homo sapiens; identical to SEQ ID NO: 4872

SEQ ID NO: 4875 - DNA, 4243 bp, Homo sapiens; identical to SEQ ID NO: 4872

SEQ ID NO: 4876 - DNA, 4236 bp, Homo sapiens
cggggactcggaggtactgggcgcgcgcggctccggctcgggacgcctcgggacgcctcggggtcgggttccggttgcggctgctgctgcggcgcccgcgcttccgtagcgttccgcctcctgtgcccgccgcggagcaagtctgcgcgcccgccgtgcgcccctaagctccttttacctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggacccgctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcaaacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttagccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagccgtgctccaagtgctggaaaagctcaagttcacaccaccaccccagccacagcagtgcatggggtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctggaagacctcaagcagttcctgaggatttccaagagcaaggatgaaaaattgaagtcacagcccctcagcaccaagcagaaggtggccctatgcacccaggtagccctgggaatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtggcgctgcgctggatgtcccccgaggccatcctggagggtgacttctctaccaagtctgatgtctgggcctccggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacggtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtgtgtttgtgtttttttgtttttgtttttgtttttacactcgctgctctcaataaataagccttttt

SEQ ID NO: 4877 - DNA, 2568 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgt

SEQ ID NO: 4878 - DNA, 2568 bp, Homo sapiens; identical to SEQ ID NO: 4877

SEQ ID NO: 4879 - DNA, 2462 bp, Homo sapiens
ggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactatatgtaagattgtcccataaagaaattacgggtattgcttttaaataacctttataagaatgcagcatcttcctacctcttcagttcttcagagattcagtaccaagagcaaaattcactactggactttacatttgacttgccaaagttaagtaatcaaatat

SEQ ID NO: 4880 - DNA, 2124 bp, Homo sapiens
attccgctcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactataaaaaaaaaaa

SEQ ID NO: 4881 - DNA, 930 bp, Homo sapiens
atgatcaaccatcttttgctcaacaacagtgccaagatgtccatcctggggccaggtacctggaagtctcctccagacctggtgaccgagtctgtaaatgtggtgattaacattgggtactgccacatagattgtgcccacgtgtaccagaatgagaatgagtcaggggtggccatttaggagaagctcagggagcaggcagtaaagtgcaagtagctcttcatcatcagcaatctgtggtgcacatgtcttaagaagggtctgctgaaaaaaacctgccagaagatgctcagttacttgaatctggactacctagacatctaccttattcactggacaactggctttaagccagggaagaaatttttcccactggatgattcagccattgtatatcccaatgacaccagcattgtggacacatgagcagccatgaaagagctggtggatgaagggttggtgaaagctattggcatctccaagttcaactattctcatgtcaggaggatcttaaacaaacgtggcttaaagtatcagccaatggttaaagagattgagttctgcacatacctaactcaaaagaagttaatccagtactgccagtccaaaggcatcatggtgactgcctatagcccccttgactgtctggacaggccctgggcaaagctcaaggattcttctgtcctggaggatgccagaagcaaggtgatcacagtcaaacataataaaactacagctcaggttctgatttgatttcccattcagagaaacttggtggtgaatcccaagtctgtgacacaaaaatgcattgcagagaactttaaggccttttactttgaactaagcagcaaggatatgaccaccttacctagctacaacagaaactgtgccttggtaagctgtacctcgcacaaggattaccccttctag

SEQ ID NO: 4882 - DNA, 1929 bp, Homo sapiens
gggtacgtggttgccggcccggtctccgcagtccccaccgagccccgaccctcctggccgccccctcgccttacctcgtcgccatgcgcctccgccgcctagcgctgttcccaggcctggcgctgctcctcgccgcggcccgcctcgctgctgcctccgatgtgctggaactcacggacgacaacttcgagagtcgcatcaccgacacgggctcttctggcctcatgctcgtcgagttcttcgccccctggtgtggacactgcaaaaagcttgccccagagtatgaagctgcagctaccagattaaaaggaatagtcccgttagcaaaggtggattgtactgccaacacgaacacctgtaataagtatggagtgagtggatatccaaccctgaagatatttagagatggtgaagaatcaggtgcctatgatgggcctaggactgccgatggaattgtcagccacctgaagaaacaggctggaccagcttcagttcctctcaagtctgaggaagaatttgaaaagttcattagcgataaagatgcttctgtggtgggttttttcaaggatttattcagtgaagctcactctgagtttctaaaagcagccagcaacttgagggataactaccggtttgcacacaccaatgttgaatctctggtgaacaaatacgatgacgatggagagggtatcaccttgtttcgtccttcccatctgacgaacaagtttgaagacaagactgtggcatatacagaacagaaaatgaccagtgggaagattaaaagatttattcaggaaaacatttttggtatctgccctcacatgacagaagacaataaagatttactacagggcaaggatttactcatcgcttactatgatgtggactatgaaaagaatgctaaaggttccaactactggagaaacagagtaatgatggtggcaaagaaattcctggatgctgggcagaaactccattttgctgtagctagccgtaaaacctttagccatgaactttcagattttggcttggaaagcactactggagagattcctgttgttgctgtcagaaccgcaaaaggagagaagtttgtcatgcaggaggagttctcgcgtgatggcaaggctcttgagagattcctggaggattactttgacggcaacctgaagagatacctgaagtctgagcctatccctgagagcaatgatgggcctgtaaaggtagtggtagcagagaattttgatgaaatagtgaataatgaaaataaagatgtgctgattgagttttatgctccttggtgtggtcactgtaagaatctggagcctaagtataaagaactgggagagaagctcagaaaagatccaaatattgtcatagccaagatggatgctacagccaacgatgtgccttctccatatgaagtcagaggttttcctaccatctacttctctccagccaacaagaagcaaaatccaaagaaatatgaaggtggccgtgaattaagtgattttattagctatctaaagcgagaggctacaaacccccctgtaattcaagaagaaaaacccaagaagaagaagaaggcacaggaggatctctaaagcagcagccaaacatcatatactttgtcaaaggacttttccaccagagatgggaaaaccaatggggaggactgggacccgtatgggaattactgcctctcagggctgagagggcagaatggttataatctgagtcctgttaaattttctctaaactgtttcttagctgcactgtttatgaaaataccagaaccagtttatgtttgtggttttgggaaaattatttgtgttgaggggaatgttgtgggggtggggggaattgagttggggggttattttctaattttttttgtacatttggaacagtgacaataaatgcgcccccttt

SEQ ID NO: 4883 - DNA, 3070 bp, Homo sapiens
ccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagtttt

SEQ ID NO: 4884 - DNA, 3070 bp, Homo sapiens; identical to SEQ ID NO: 4883

SEQ ID NO: 4885 - DNA, 1913 bp, Homo sapiens
aattcggcacgaggcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatctcgtgccg

SEQ ID NO: 4886 - DNA, 3070 bp, Homo sapiens; identical to SEQ ID NO: 4883

SEQ ID NO: 4887 - DNA, 1957 bp, Homo sapiens
aagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgta

SEQ ID NO: 4888 - DNA, 4103 bp, Homo sapiens
ctcacagcccgaaactgcaaggagctcctctgcccggcctctctttactcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacgcggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaaggcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 4889 - DNA, 4103 bp, Homo sapiens; identical to SEQ ID NO: 4888

SEQ ID NO: 4890 - DNA, 12620 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcaccgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtgggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactaca

SEQ ID NO: 4891 - DNA, 7358 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcaccgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtgggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactaca

SEQ ID NO: 4892 - DNA, 9659 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcaccgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtgggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactaca

SEQ ID NO: 4893 - DNA, 12620 bp, Homo sapiens; identical to SEQ ID NO: 4890

SEQ ID NO: 4894 - DNA, 9659 bp, Homo sapiens; identical to SEQ ID NO: 4892

SEQ ID NO: 4895 - DNA, 7358 bp, Homo sapiens; identical to SEQ ID NO: 4891

SEQ ID NO: 4896 - DNA, 4330 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcaccgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtgggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaatatttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatctgtaaaatgtgaatgactttttttgtgaatgaaaatctaaaatctttgtaactttttatatctgcttttgtttcaccaaagaaacctaaaatccttcttttactaca

SEQ ID NO: 4897 - DNA, 3309 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 4898 - DNA, 2271 bp, Homo sapiens
ggcacgagcgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctttatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaaaaaaaaaaaaaaaaaaaaa

SEQ ID NO: 4899 - DNA, 2805 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 4900 - DNA, 3348 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaatatcctgggagccgggcttttccttaaccccaccctacattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 4901 - DNA, 3323 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggtgagagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaaggtgacttccgatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 4902 - DNA, 2478 bp, Homo sapiens; identical to SEQ ID NO: 3224

SEQ ID NO: 4903 - DNA, 967 bp, Homo sapiens
ggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaa

SEQ ID NO: 4904 - DNA, 1121 bp, Homo sapiens
ggcccaggaggctgggcagctgaggcagggagggagggaaataactgtgcctgattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtc

SEQ ID NO: 4905 - DNA, 1121 bp, Homo sapiens; identical to SEQ ID NO: 4904

SEQ ID NO: 4906 - DNA, 6933 bp, Homo sapiens
gacatcacagctccaggaactcagatcttcagactcagggtgaaggacaccaccagctttccaggttccccagcttgcagacggcatacggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacac

SEQ ID NO: 4907 - DNA, 1953 bp, Homo sapiens
atgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatag

SEQ ID NO: 4908 - DNA, 6724 bp, Homo sapiens
gacatcacagctccaggaactcagatcttcagactcagggtgaaggacaccaccagctttccaggttccccagcttgcagacggcatacggtcttgactccactaacggggacttctcatacggctttgaacttggaccttggtgcataagcaaatgtaactcagcgaattgtaatggaaagcatatggacaggtctacgccacatcacttagtgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacac

SEQ ID NO: 4909 - DNA, 6724 bp, Homo sapiens; identical to SEQ ID NO: 4908

SEQ ID NO: 4910 - DNA, 6933 bp, Homo sapiens; identical to SEQ ID NO: 4906

SEQ ID NO: 4911 - DNA, 1487 bp, Homo sapiens
gacatcacagctccaggaactcagatcttcagactcagggtgaaggacaccaccagctttccaggttccccagcttgcagacggcatacggtcttgactccactaacggggacttctcatacggctttgaacttggaccttggtgcataagcaaatgtaactcagcgaattgtaatggaaagcatatggacaggtctacgccacatcacttagtgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggtacgttcctgagaagacaagttcc

SEQ ID NO: 4912 - DNA, 6933 bp, Homo sapiens; identical to SEQ ID NO: 4906

SEQ ID NO: 4913 - DNA, 2997 bp, Homo sapiens
agtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatgaaaaaaaaaaaaaaaaaaaaa

SEQ ID NO: 4914 - DNA, 2482 bp, Homo sapiens
gaggaccccgggctgggcgccgccgccgatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatacaacatctttttcctccctttccctgagagctcacagtacaatgtttcagaa

SEQ ID NO: 4915 - DNA, 2980 bp, Homo sapiens
ggccagtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatg

SEQ ID NO: 4916 - DNA, 1401 bp, Homo sapiens
atggctttacttactgcggccgcccggctcttgggaaccaagaatgcatcttgtcttgttcttgcagcccggcatgctagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtgtatgaaacatcagttcttgatcctgatgagggcatccgtttccgaggctttagtatccctgaatgccagaaactgctacccaaggctaagggtggggaagaacccctgcctgagggcttattttggctgctggtaactggatgtatcccaacagaggaacaggtatcttggctctcaaaagagtgggcaaagagggcagctctgccttcccatgtggtcaccatgctggacaactttcccaccaatctacaccccatgtctcagctgagtgcagctgttacagccctcaacagtgaaagtaactttgcccaagcatatgcacggggtatcagccgaaccaagtactgggagttgatttatgaagattctgtggatctaatagcaaagctaccttgtgttgcagcaaagatctaccgaaatctctactgggaaggcagcggtattggggccattgactctaacctggactggtctcacaatttcaccaacatgttaggctatactgatcatcagttcactgagctcatgcgcctgtacctcaccatccacagtgaccatgagggtggcaatgtaagtgcccataccagccacttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaa

SEQ ID NO: 4917 - DNA, 2482 bp, Homo sapiens; identical to SEQ ID NO: 4914

SEQ ID NO: 4918 - DNA, 1722 bp, Homo sapiens
cagccagccccgacccgtccgcgcgtgtcccgcagccgcccgccacacgcaccgagcatgagggagatcgtgcacatccaggccggccagtgcggcaaccagatcggagccaagttctgggaagtcatcagtgatgagcacggtatagaccccagtggcaactatgtgggcgactcagacctgcagctggaacgcatcagcgtctactacaacgaggcctcttctcataagtatgtgcctcgggccattctggtggaccttgagcccggaaccatggacagcgtccggtctggggcctttgggcatcttttcaggcctgacaacttcatctttggtcagagtggggctggcaacaattgggccaaaggtcactacacggagggcgcagagctggtggactcagtcctggatgtggtgcggaaggagtgtgagaattgcgactgcctgcagggcttccagctgacccactcgctcggcgggggcacagggtccgggatgggcacactgctcatcagcaaggtgcgcgaggagtaccccgaccgcatcatgaacaccttcagtgtggtgccctcccccaaggtgtcggacacagtggtggagccctacaacgccacgctgtccatccaccagctggtggagaacacggacgagacctactgcatcgacaatgaggctttgtacgacatctgcttccgcactctcaagctggccacgcccacctacggtgacctcaaccatctggtgtcggccaccatgagcggcgtcactacttctctccgcttccccggccagctcaatgctgacctgcgcaagctggccgtgaatatggtgcccttcccccgcctgcacttcttcatgcccggctttgccccactcaccgcgaggggcagccagcagtaccgcgcgctcacggtgcccgagctcactcagcagatgttcgacgccaagaacatgatggctgcctgtgacccccgccacggccgctacctgaccgtggccaccgtcttccgcgggcgcatgtccatgaaggaggtggacgagcagatgctggccatccagagcaagaacagcagctacttcgtcgagtggatccccaacaacgtgaaggtggccgtgtgtgacatcccaccccgggggctcaagatgtcctccaccttcatcggcaacagcacggccatccaggagctgttcaagcgcatctcggagcagttcacagccatgttccggcgcaaggccttcctgcactggtacacgggcgagggcatggacgagatggagttcactgaggccgagagcaacatgaacgacctggtgtccgagtaccagcagtaccaggacgccacggccgaggaggagggcgagatgtacgaagatgacgaggaggagtccgaggctcagggccccaagtgaagcgggaggggcagagccaggctgtcgctgtggcccagaggcctgtcccccagagccacgtcgccactgacaccgccccaagccttgcccccaccagctctggccacagcgccctagggctcccgagtgtttgtcctccagtatttacggcatccccaccccacgtgagtcctgttttcccaccataggtcagctccatcgtgtctgctttatttgtcagctccaggcctgttttatggtttgttttgttttttgtttttactggtttgtgtttatattttgggggggaatacttaataaatttattgctgt

SEQ ID NO: 4919 - DNA, 1949 bp, Homo sapiens
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 4920 - DNA, 1418 bp, Homo sapiens; identical to SEQ ID NO: 3690

SEQ ID NO: 4921 - DNA, 1703 bp, Homo sapiens
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 4922 - DNA, 912 bp, Homo sapiens
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcct

SEQ ID NO: 4923 - DNA, 2741 bp, Homo sapiens
ccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaaggtgggcgcgccgcagcggagggggtccaatgggggcgcgaacctgggccgagagcccctcggggtccccaggcgcggtcctgggaaggcctggggatcgccaaatgcagaccttcctggccgctttgtgccgccgagtgtggcctgggctaggaggtgactttcgcggacggagggggcacctctctttctttctgctgtaactcatttggagtccccgtcaccccctcggcctccctccgcgctggctgcttggcaggcacgcgtgcctggagaagacgagggtgtgtccgcgaggctgtgcgcggcgctccgcgcgaggggctgggacaccaggaggattaattgtactcgcttgaaccggagtcgagctgccgggggaggggaggagagcgattgtcttgcggtctcaggacgtgctttgaatctaaaaccgcggtcctttagctcctttgcgttcctctttccccgcccacccgctcctggcgggctgcagtccctgtgccctcgcctcctgccgcagcctggggctgcgaccagtgcgccaagctccgccactgcccggctttggctggtccttaccccctcgacccctacctccccccgcgagcggcagctgtttgcctgggaaacgcccagtttcaactttctgaacctgcaaaatacaagccccgcggctgtgcccgggtcacgacgccctttaaagcttcaagctcctgaaatgttgggttgtcggaactgagtcggggacatttcattgtgagccttggcgtttctgggggcatcgttcatggctaaatgcagcctttctgtctcagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagcaca

SEQ ID NO: 4924 - DNA, 1956 bp, Homo sapiens
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 4925 - DNA, 757 bp, Homo sapiens
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcc

SEQ ID NO: 4926 - DNA, 5465 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaa

SEQ ID NO: 4927 - DNA, 5444 bp, Homo sapiens
ctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccattttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacaccatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtttacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 4928 - DNA, 5480 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaaaaaaaaaaaaaaaaa

SEQ ID NO: 4929 - DNA, 724 bp, Homo sapiens
gccacggcggcgcgtggtgcacgcggttcgattgtgacggcccggctgcgctttcaggatgaccgagtgggagacagctgcaccagcagtggcggagacccctgacatcaagctctttgggaaatggagcactgatgatgttcagatcaatgacatttctttgcaggactacattgcagtgaaggagaagtatgccaagtacctgccccacagtgcaggccgctatgcagccaagcgcttccgtaaggcacagtgccccattgtggagcgcctgaccaactcaatgatgatgcatggccgtaacaatggcaagaagctcatgactgtgcgcattgtcaagcatgccttcgagatcatccatctgctcactggtgagaaccccctgcaggtcctggtgaatgccattattaacagtggtccccgggaagactcaacccgcattgggcgagctggaacagtgaggcgtcaggctgtcgatgtgtcccccctacgccgtgtgaatcaggccatttggctgctgtgcacaggtgcccgtgaggccgccttccggaacatcaagactattgctgagtgcctagcagatgagctcatcaatgcagccaagggctcttccaattcctatgctatcaagaagaaggatgagctggaacgtgtggccaagtctaaccgttgatcacctggctgtggcttcaataaacctgtctgcccttggggcagcctcacc

SEQ ID NO: 4930 - DNA, 793 bp, Homo sapiens
taggctacctccgcgctccacccagagacgggtcgcgctgctcccgccgccgcaaccccgggccctcgtgccggcggtctcccctcttccacgggcgagattactgcatagcagaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccacctgtgc

SEQ ID NO: 4931 - DNA, 793 bp, Homo sapiens; identical to SEQ ID NO: 4930

SEQ ID NO: 4932 - DNA, 1174 bp, Homo sapiens
tccgcatcaggcgcgtgccggtgaggcggctgtggccgcggcgaggagtcagagggaactgaactggctactcccgcggcaggtgggatttaaggtcagcagctgaacaaagaagcgagcgctggccagacttttttctttattagacatggctgcgttggtctcacggaaatctctgcgcttttgcaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccacctgtgc

SEQ ID NO: 4933 - DNA, 2219 bp, Homo sapiens
ttggacctagcttggcgcggaatccgtgaattgcccgcggcccgagggtgcaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggtgagaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 4934 - DNA, 822 bp, Homo sapiens
gcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactac

SEQ ID NO: 4935 - DNA, 822 bp, Homo sapiens
ataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactaaaaaaaaaaaaaaaaaaa

SEQ ID NO: 4936 - DNA, 357 bp, Homo sapiens
atgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttag

SEQ ID NO: 4937 - DNA, 1395 bp, Homo sapiens
cgggaacggaattgttagcccctccacccccacccccatcaaggtcaagaaattgaagcggggcggggggcggtgagcataactactcaatccccattttctcatctgaggaactaaggcacgaaacagggagtgccgaagggtacaccaggcctgatgtcctaatgcagaaaccgggccttcctgcagtgggccgggtcagctcggatctccgcgcggtcctgagtcgccgcccccaacccagccaaggattaatttaggcgagctatcccgcccgccatccccatatccgtccctgccagcgtggcggggagggaccccggacggaggggcagtcgctgcggggcggcgccagcgcccgtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaagagttgggccccgtctg

SEQ ID NO: 4938 - DNA, 1395 bp, Homo sapiens; identical to SEQ ID NO: 4937

SEQ ID NO: 4939 - DNA, 733 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagg

SEQ ID NO: 4940 - DNA, 400 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgggaagatgtgccacctccaaagagccgtacgtccactgccagaagctacatcggcag

SEQ ID NO: 4941 - DNA, 2053 bp, Homo sapiens
cgtacctggctggctcgtggggcatcagagcttacctcacccctccctgcgtccagacctggaggaggccgcagggtcccgccgtccgcgcgctgggggcgcccccgggcggcggaccccgcgcgccccgcccgggaggacggcgacctctccgccccctcgaatgccccgccccgctgtcgccgtcggtccccaccccgccaccggcacacaggcgcgcagacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaacaag

SEQ ID NO: 4942 - DNA, 1838 bp, Homo sapiens
cgattacatttccggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccgaaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatgatgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgaaaaaaaaaaaaaaaaa

SEQ ID NO: 4943 - DNA, 9709 bp, Homo sapiens
ggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtggttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttat

SEQ ID NO: 4944 - DNA, 3759 bp, Homo sapiens; identical to SEQ ID NO: 3310

SEQ ID NO: 4945 - DNA, 2866 bp, Homo sapiens
gagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaaccttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcagtctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaagggatgtccaatcttttggcttccctgagccagcgaattgtgcaca

SEQ ID NO: 4946 - DNA, 3555 bp, Homo sapiens
actcccgagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgacatgaatgttactaaattttctaattaaagatggtttatgcatgtatatgccactatttttgtagttagacaatagtttttaaaagaatttcatagatattttatatgtatggatctatattttcagagcttatctctgaagatctaaacttttgagaatgtttgaaaattagagatcacgattatataattttccagtataaaacaagggaaaaatttttatgtaaaaccctttaattgtaaaatatttgagaataagttcatataattgtcttaagttttttatgcctttatatacttagctatattttttcttttgacataactatctttttgaaagcaatattatactgacagaggctcaatgagtgatactttaagttaaatatgtagatcagggatgtccaatcttttggcttccctgagccacattggaagaagaattgtcttgggcctcacataaaatatgctaacactgatgacagctgatgagcttaaaaaaaaaattgcaagaaaaatctcatgttttaagaaagtttacaaaaaatgtaaaatatttgagaataagtccatataattgtcttaagttttttatgcctttatatacttagctatattttttcttttgacataactatctttttgaaagcaatattacactgacagaggctcactgagtgatactttaagttaaatatgtagatcagggatgtccaatcttttggcttccctgagccacattggaagaagaattgtcttgggccgcacataaaacatgctaacactgacgatagctgataagcttaaaaaaaaattgcaagaaaaatctcaagttttaagaaagtttacaaatttgtgttgggctgcattcaaagctgtcctgggctgcattcgacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccacagccatattttgacatttcacaaagaatggttctaatctactagagtacatttggctaaatagataacttacctaaatttgctccaaagctaaatcacaagtaaacatatttatgtttaaaacacagaaataaataacttaagatttttatccaagtggtcagtgttgtattggaaagatatatctataaataaactttgaactgatttcaaacttagaatttatgtttttatatttttccactaatatcattatcacttctg

SEQ ID NO: 4947 - DNA, 3555 bp, Homo sapiens; identical to SEQ ID NO: 4946

SEQ ID NO: 4948 - DNA, 3555 bp, Homo sapiens; identical to SEQ ID NO: 4946

SEQ ID NO: 4949 - DNA, 3555 bp, Homo sapiens; identical to SEQ ID NO: 4946

SEQ ID NO: 4950 - DNA, 3555 bp, Homo sapiens; identical to SEQ ID NO: 4946

SEQ ID NO: 4951 - DNA, 1950 bp, Homo sapiens
atggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaaccttctgaacaatgaggcacatgctattactatgcaagtgacaaagtccacgcagaactctttcagggctgaatcgtctcaaacttgtcattctgaacaaggtgataaaaagatggagaaaaaaaattcaggcaacttccagaagaaggctgcaaacatgcttcagcagtctggttctaagaatacaggagctaagaaaagaaaaatcgatgatgcctag

SEQ ID NO: 4952 - DNA, 2486 bp, Homo sapiens
atgcgctgtgtgtccctgcttctagatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaaaaaaaaaaaaaaattgctctatgcaagttttttagccccatgtaaaaaggaaaaataaaagttgctctaaagctacatataat

SEQ ID NO: 4953 - DNA, 1726 bp, Homo sapiens
gcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaaaaaaaaa

SEQ ID NO: 4954 - DNA, 2662 bp, Homo sapiens
ccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaaaaaaaaaaaaaaattgctctatgcaagttttttagccccatgtaaaaaggaaaaataaaagttgctctaaagctacatataat

SEQ ID NO: 4955 - DNA, 897 bp, Homo sapiens
ccggtgtggcggctggactgcgctgcaggcctccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctgctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaaacctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctt

SEQ ID NO: 4956 - DNA, 1470 bp, Homo sapiens
gggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatt

SEQ ID NO: 4957 - DNA, 1494 bp, Homo sapiens
gggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaaggtacgggcaggtgggcgtcgagggacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatt

SEQ ID NO: 4958 - DNA, 1470 bp, Homo sapiens; identical to SEQ ID NO: 4956

SEQ ID NO: 4959 - DNA, 1749 bp, Homo sapiens
atgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 4960 - DNA, 2806 bp, Homo sapiens
gcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagatt

SEQ ID NO: 4961 - DNA, 2623 bp, Homo sapiens
gcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagatt

SEQ ID NO: 4962 - DNA, 2623 bp, Homo sapiens; identical to SEQ ID NO: 4961

SEQ ID NO: 4963 - DNA, 3783 bp, Homo sapiens
atgtggagggagttcataattcatccattgctcttagcgactgttttggactcaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggctgtcactgaaatttcatgctccattctgagcactatgcttcaagaggcagtgaggcaaactggaacatatttaggagggagcgtccttgttgcatgaaaagtgattgtaggatagtgaccgaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctc

SEQ ID NO: 4964 - DNA, 4125 bp, Homo sapiens
cgcgcgcttcccggccagacttggggccccggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctc

SEQ ID NO: 4965 - DNA, 4125 bp, Homo sapiens; identical to SEQ ID NO: 4964

SEQ ID NO: 4966 - DNA, 3865 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcaaaaaaaaaaaaaaaaaaaaaaaaaa

SEQ ID NO: 4967 - DNA, 5291 bp, Homo sapiens
cgtggctcctccttgcgggcggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatccccttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 4968 - DNA, 6024 bp, Homo sapiens
cgtggctcctccttgcgggcggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatccccttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctccc

SEQ ID NO: 4969 - DNA, 2583 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacactgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 4970 - DNA, 3410 bp, Homo sapiens
cggtccttccgacacacgagctccaagccgctcctctcttttcctaaagcccttcaaggcagtcttcggtttccttctttccagccgaccctcttcagccccgcgaagatggtggaccgcgagcaactagtgcagaaagcccggctggccgagcaggcggagcgctacgacgatatggccgcggccatgaagaacgtgacagagctgaatgaaccactgtccaacgaggaacggaacctcctgtcggtggcctacaagaacgtggttggggctcgccgctcctcctggagggtcatcagcagcatcgagcagaagacgtctgcggatggcaacgagaagaagatagagatggtccgagcctaccgggaaaagattgagaaggagctggaggccgtgtgccaggacgtgctgagcctgctggacaactacctgatcaagaactgcagcgagacccagtacgagagcaaggtgttctacctgaagatgaaaggggactattaccgctacctggctgaagtggccactggggagaaaagggcgaccgtggtggagtcgtccgagaaggcctacagcgaagcccacgagatcagcaaggagcacatgcagcccacccaccccatccggctgggcctggcgctcaactactccgttttctactacgagatccagaacgccccagagcaagcctgccacctggccaagaccgccttcgatgacgccatcgccgagctcgacactctgaacgaggactcctacaaggactccactctgatcatgcagctgctccgagacaacctaacgctctggacgagcgaccagcaagacgacgacggcggcgaaggcaacaactaaggccccaggtggactggcagcgcacgctgatgctactactgcagtctttattttttcccatgagttgggggtcgggtgggggagggaaagggagggctgaccttcccagggagaaacccacgactgtcctgtctttgattgcctctttgacatttttgccaaaataccactagtggaaagtcaggctagctatgctggtatcggagtagcagcctcacaggcgccgggactgttgtgcaggtcgtgcaagtggagctgtctgcctttagtttaacttattgctagacggtagggttctaagcagaaagaccggatggatggccctctcgttcagtgcgttctgtggttccagtaaggattcttctgtccacacgccctcgtcttcagttccgtggctgttttctctctgtggctctgctgttttctttttctcttttctcctttctttccccggggtgtataccagagaagttagagtctaaattacccaagtggacaggcttagagtggaaggcacaacctttattgacgagtcagacgtggccctgtacttagaagtctctgatgggttgacagtattaacactaaattgtagtttacagtatttctacacgacagccatacatgacaccaagccattggttctgagttttcctttgtcagtcggctttacgtctgtgtccaggtcggtctggctgtccatcagctctcgtcatggggagagtcagcttcccggagttttggttgatgggcgcttggcaggtggctgttggggaatacttttttttttttttcttctcggttcttctttactctctaaggcaagcccatcacaaaaatagaaaccgttaagtaccacacacacacagagaaaacagagaaaattcaggtctgtatgtcattatcagagactcctgctctcagcagccagggctccatcctcagtgtcactgccgcttgaatgtttctctgcacttgagtctgcccgtaccccgtgctagcagcacgcaggtatctaggtgtcgggcaagattgcagaggtgggaggttaacgagacttggaacatccggtgccagcagctgagccaacaggaaaccactgggaagaggcagttctggtcctaaaccagttgtccctgccacccctccaacccccagcactccttccccaagtgctcagtggagggtaccgaggttcagcaggaggcgctgctcacccctgtctgacctaagctttcctggttttcctttctgaatgaaatcgtagttgatggagattggcttctcacgagatcactgcacacgtgacattgaaggaagctgtgctgctatgccctacatggtccgtctcagcccttggtccctcattctcactgtggataaatcttcccataaacgtgccctgttgcatgcagagtgtgcagtttgtctcctggagaacccatgctctcatggcttcccaagatggcagcaccctagacttgctttacttgtcttcagaggcccagcagccactttatcttatactgaaaccaagctcccacttaagttgagtcacgcttaacaggatgctggtgacgtggctgtagaagaagtacgcccctctgcacagtcctagcatgccctccctcagaggcccctcctcatgctggtgtgcaaacacccactaaccgaggcccacggaagaccgcagcggaggaagcttggccaccagagccatggacagaggggttgggcttcacccggttggtttgtctccatgtcggcagtgagcatgtctgtcccgcttgtactgtttggaaatgacctactggaattgcaaaacctagtttctctttaaatttcagccttgacctttgctgtgttctagaaaagtcatgtgagggtagaactgaagagggagagcgggagacctgacgtgagcgtggatggttccttctccttcccttactgttgagaagcgcacctgcctctgatgctgtctccgttgccgcggttgccccacctattgatacagtattgtgcatgctggtgttgtatttctatacggtagctgacatttattaccttacactgtaggcgttatgtattcctatgacaacaaaacttaagacttcaaaatctttttaaactttttttttttaatttaattttttcctttcaggggtaaagtttgctttaccaaaaatagtggttgtaacaaattgatctgttttggatgttgctatagtgacatgcagttctctattttgttttcggggggaggggacaaaagaaacaccagtgttagcttactcttaatgtctggtgtttgtcatggtgaaattataactattacagtgttggagaacgccgcggagcttctctgaacgacctctgtgctttcttgtcatgttatgcagtgaaactatttttaaggtctaatcaagtgattttttcccccccaactccgtgtttcgctaaggaattatttcgcacacggaccattcttagcagtttcctcagtgatggaatattcatgaatgtgagtcattatgtagccgtcgtacattgagcaa

SEQ ID NO: 4971 - DNA, 3729 bp, Homo sapiens
agccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctg

SEQ ID NO: 4972 - DNA, 2884 bp, Homo sapiens
caccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactgtggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagtgtgaggagctgagcgacgctagatgggccgagctcctccctctgctccagcagtgccaagtggtcaggtacgcttgctctcggggtggccttggggtgctggtggggcaggctggtgggtggcggctccctctgaagggtgcattgctctggaacgccttgtttgtggacatgaagtatgaattctgtgcagctaccacgtgcatgagatgtgattcttgtgtttctttttgacaatttaggaatgtaaaacccattccaggctcatgcagcatgggctgaggtgggcgggccgaggtgggcggccactggccagtgggtctctggctccggtgtctcagctcctctccctcccttggagacacgagggcaggacacagcttgggtcccctccgtgagcctccatggggcgctgcttgtccctgccaagctgggggctgggagtcctcggccctcgaggtcctcacaaacccagcagcttcacaagcaggacacgagtgcctgggtgggccgcatcttttctctttttacctggtgatttcaagtagtgtcaggtttgcggaggagttacgaggaccggacggggctccctggtgaggtggtcctgtgtacctgcggacgctagctctggcccagcacctccaggcagggtctgcttttccgccctgcccttttcgtcttcctcactggtccaggattgcgtggccctcagccctctgtctccttagccctctcccgtctgtgactgtcccctcgtctctctgggttcttggtggtctgagggtctggccaggctcctgcaggacgtcctctgttggggcttgtctggtggtttcttgtggttgaagtcctacagttttggcaggaatgcagggagatgccgtggggcctgccaggagcgtcctgtcacaggcgccgtctgccaccctctccactgtgacgccactgcctttcctcctgtgactgatcagtgccttcgagagatactttaaattctttttatttttagagacagggcattgcttctgtcgcccaggctggagtgcagtggtgcgatcttggctcactgcaagctccgcctcccaagttcatgccattctcctgtctcaacctcccgagtagctgggaccacaggcgcccgtcaccacaccaggctaattttttgtacttttagtagagatggggtttcaccgtgttagccagtatggtcttgatatcctgacctcgtgatccgcctgcctcggcctcctaaattgctgggattacaggcgtgagccaccacgcctggcctaatttttgtatttttagtagagatggggtttcaccatgttgggcaggctggtcttgaactattgacctcaagtgatgagcctgcctcagcctcccaaagtgctgcgattacaggcgtgagccactgtgaccttgtgtgcacgatctgctttttctcgttggcagcttttcaagctctctttgttcactgtgttaggggttccatgtgcttggccttgatgggggtcttggttctttgtgctggatacttggttctactaagaaaatatacctttggtgatttttttctctctcctttcttatgtttcttttttggtgtgcccatgagcctgtcctgatgtcttgtggagtgaccctctaattatgttctccaaattttcttttcgatgttttgttttatttttgggagatgttctcatttaccagccagtctactgaatttccaccctcagtgttttgtcttttgtttgctgtttcccgtgtgcctctcgccaggggctttccgtgggtggctggtcatcctgggctgggcaccaggtgcagagtgaggcccgg

SEQ ID NO: 4973 - DNA, 4401 bp, Homo sapiens
gagctggaacatgtgagccgacaccttcggcctccgcagtatgttacccgagagccacctgaaggcagccttctcgacgtggacatggatggctcctcgggtacatactggccagtgaactcagaccaggccgtgcctgagcttgatttgggctggcctctgaccttcggcttccagggcaccgaggtgaccaccttggtgcagccaccgccccccgacagccccagtatcaaggatgaggcccgcaggatgatccgttccgcccagcaggtggtggccgtggtgatggacatgttcactgatgtggacctgctcagcgaagtgctggaggccgcggcccgtcgggtcccagtctacatcctgctggatgagatgaacgcgcagcacttcctggacatggccgacaagtgccgtgtcaacctgcaccacgtggatttcctgcgcgtacggactgtggcgggccccacctactactgccgcactgggaagtccttcaagggccacgtcaaggagaagttcctgctggtggactgtgccgtggtgatgagtgggagctacagcttcatgtggtcctttgagaagatccaccgcagcctggcgcacgtgttccaaggagagctggtctccagcttcgacgaggagttccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcaccttcctgttcccgccaccccggggaagagggcctgcgggcacctgccggcgacctgctcccctcggccttccgcgtcccagcagccttccccaccaaggtcccggtgccaggcccgggcagcggcggcaacggcccagagcgcgagggcccggaggagcctggcctggccaagcaggactcattccgctcgcgcctgaaccccctggtccagcgcagctccaggctgcgctcctcgctcatcttcagcacgtcacaggccgagggcgcggccggggctgcggcggccactgagaaggtgcagctgctgcacaaggagcagacggtcagcgagacgctggggcccggcggagaggccgtgcgctccgcggcttccaccaaggtggcggagctgctggagaagtacaagggcccagcccgtgatcccggcggcggcgcgggcgccatcaccgttgccagccacagcaaggccgtcgtgtcccaggcgtggcgggaagaggtggcggccccaggtgccgtggggggcgagcgccgcagcctcgagagctgcctgctggacctgcgcgactcctttgcacagcagctgcaccaggaggcggagcggcagccgggagccgcgtcgctcaccgcggcgcagctgctcgacacactgggccggagcggctccgaccgcctgccttcccgcttcctctctgcccagagccactcaacgtccccgcaagggctggacagccctctgccgctggaagggtccggagcgcaccaggtgctccataatgagtcaaaagggagccccacctcggcttaccctgagcggaaggggagccccacgcctgggttttccactcgaagaggaagtccaactacaggatttatcgagcagaaggggagccccacctcagcctaccccgagcgcaggggtagtccggtgccccccgtgccggagcgcaggagcagtccggtgccccccgtgccggagcgcaggggcagcctcacccttaccatctccggggagtccccgaaggccgggcccgcggaggaggggccgagcggccccatggaagtcttgcgcaaaggctccttgcgtcttaggcagctgctgagccccaagggcgagcggcgcatggaggatgagggtggcttcccagtgccgcaggagaacggccaacccgagagcccgcggcgtctgtcactgggccagggtgacagcacggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggcattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagt

SEQ ID NO: 4974 - DNA, 21785 bp, Homo sapiens
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaacggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacaacattctcaaatcaaaacgctcaacagaaaagaaaggaaagtttactctgccaggcagagagaagcaggccacttctgatgtgcaggagtctactcaggaatcagctacagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 4975 - DNA, 21785 bp, Homo sapiens; identical to SEQ ID NO: 4974

SEQ ID NO: 4976 - DNA, 21813 bp, Homo sapiens
gccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagaaaaaaaaaaaaaaaaaaaaaaaaaaaaaaaaaaaaaaaaaaa

SEQ ID NO: 4977 - DNA, 21605 bp, Homo sapiens
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatgtaagtactaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgagactctggtcacaaatgtgtcaactgttactaaagtacccacagttggcttttgtcaggacacagtgtcctcagaagcacagcttttgagaaaacgagcaaatcaggccccactggagtactggtcctttgagacacctggtgcttttcattatcttcgtgcttttcgtcctcttggtggtccttctgctagaaataacctctctccccttttacttggagaacttgtccttatttcttccacatatagctcagatgcttccctcttggggaccatcaccacatctgagaatagaggaggggatccccacagtgaggcaccatttgcaaaatcagataatcagccatcaactgaaaaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaacggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacaacattctcaaatcaaaacgctcaacagaaaagaaaggaaagtttactctgccaggcagagagaagcaggccacttctgatgtgcaggagtctactcaggaatcagctacagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcaggattccaagtgttttagaagtggaccaagaccaaatatttatgtttcttattatgttacagttatacagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggtgggtacaaagcccatttggaaaaccaaggccaagtcagcccaacagatgggggcaaatattctcctagattttgatggagcagcagcgggtagggaattgtggtttgaaaggaggaagaggtgtttgccatccctttttcttctgcaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 4978 - DNA, 6890 bp, Homo sapiens
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcatgtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgagactctggtcacaaatgtgtcaactgttactaaagtacccacagttggcttttgtcaggacacagtgtcctcagaagcacagcttttgagaaaacgagcaaatcaggccccactggagtactggtcctttgagacacctggtgcttttcattatcttcgtgcttttcgtcctcttggtggtccttctgctagaaataacctctctccccttttacttggagaacttgtccttatttcttccacatatagctcagatgcttccctcttggggaccatcaccacatctgagaatagaggaggggatccccacagtgaggcaccatttgcaaaatcagataatcagccatcaactgaaaaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaacggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacaacattctcaaatcaaaacgctcaacagaaaagaaaggaaagtttactctgccaggcagagagaagcaggccacttctgatgtgcaggagtctactcaggaatcagctacagtggaaaagttggaggaagactgggaaataaacaag

SEQ ID NO: 4979 - DNA, 3652 bp, Homo sapiens
acgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccgg

SEQ ID NO: 4980 - DNA, 4577 bp, Homo sapiens
gctacaatccatctggtctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaacgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttttattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggggtggctgaggtaggagtaacagtccctgacaccatcaccgagtggaaggcaggggccttctgcctgtctgaagatgctggacttggtatctcttccactgcctctctccgagccttccagcccttctttgtggagcttacaatgccttactctgtgattcgtggagaggccttcacactcaaggccacggtcctaaactaccttcccaaatgcatccgggtcagtgtgcagctggaagcctctcccgccttccttgctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagccgccacatttaccaggactgggaaggctgcacaggtgactatccagtcttcagggacattttccagcaaattccaagtggacaacaacaatcgcctgttactgcagcaggtctcattgccagagctgcctggggaatacagcatgaaagtgacaggagaaggatgtgtctacctccagacctccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctcaaaccagccatagtgaaagtctatgattactacgagacggatgagtttgcaatcgctgagtacaatgctccttgcagcaaagatcttggaaatgcttgaagaccacaaggctgaaaagtgctttgctggagtcctgttctctgagctccacagaagacacgtgtttttgtatctttaaagacttgatgaataaacactttttctggtc

SEQ ID NO: 4981 - DNA, 4892 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaatgtc

SEQ ID NO: 4982 - DNA, 1499 bp, Homo sapiens
gagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactctaggttgtgctggattttttttttttcttgtaacaggcatgttggactttacacggtcataggtgacctaacaaagaatgtaagacgtaggtattttattaaaaagtctattgctcaggaataatgcatcctataaagttttaacttctttgttggagagaggttaagcaaaataatgtaagatgggtaaggtcagatgctatcttggcttggctggggtgtatagggcacattagaaaaacttaattgccttaactttttggttacattgctgtaagtattaggatgttgctggtgcagtggctcacgcctgtaatcccagcatttgtaagaccaaagccaggtgatcacttcagctcaggagttcaagaccagcctgagtgacatggcgaaaccccatctctacaaaaacattcaaaagtgagccaggcatggtggagagtgtatatagtcccagctgggaagctgggagtgtggaaggtggaaggatcgcttgagccagggaggtcaaggctgcagtgagctgaaatcgtgccactgcactctagcctgggtgacagcaagaccctgtatcaaaaaacaaaagtactttttaaatgattttcttgttaaattaccttttcccatgataggcaaatgtagtttatattggtttccttgtagtcattggtatctcacctaccatttgctaatagctgagttgaaggtgctaaaaactctcagctgtattaatctactcttgctttcagaaagtaatatctaaatgaaaagcactactgcttgaataaagagtatccttagctaaattcccggagtagtttgttgagctgggggcatgccagagctgtgttaaactacaaaaatgtctgaataaactgatact

SEQ ID NO: 4983 - DNA, 949 bp, Homo sapiens
gagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggtaattatggggtttctttactttcttgaacaatacaacaggaaaattttctttttttgagacggagtcttgctctgttgcccaggatggggtgcagtggcgtgatctgatctcagctcactgcaacctctgcctcccgggttcaagtgatactcctgcctcagcctcccgagtagctgggagtacaggtgcgcgccatcacgcccggctgattttttgtttgtttgtttgtttgtttaagtagagacagggtttcaccatgtcggacaggctggtcttgaactcttgacctcaggtgatctgcccacctcagcctcccaaagtgctggggttacaagtgtgagccactgagcccggctggaaaatttattttcagtctaaattgtgataaatgaaagtttcacagttttaaggtattgaatgcaaggctcaattggaaatgatgtttgtaaccaa

SEQ ID NO: 4984 - DNA, 1499 bp, Homo sapiens; identical to SEQ ID NO: 4982

SEQ ID NO: 4985 - DNA, 848 bp, Homo sapiens
gagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgt

SEQ ID NO: 4986 - DNA, 1185 bp, Homo sapiens
gagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcaggtgaggaatgctttcattatgagcattttacctattcggatggattttaggtttgggtcttcagtaattaaagttaccatatagattaatatatgttaagctgatttggtggttaatgaaaattattgacaaattctttggatttagcctacaaataaatggaggtagggaaggaaggaatatggtcattgtacttgtccagtacagtctaactctaataataagttgtaccactaaggagtaaagtgcttttgccttaagttacttttaccccacagggctgctaaggaagcaaaaaaggctaagcaagcatctaaaaagactgcaatggctgctgctaaggtaattatggggtttctttactttcttgaacaatacaacaggaaaattttctttttttgagacggagtcttgctctgttgcccaggatggggtgcagtggcgtgatctgatctcagctcactgcaacctctgcctcccgggttcaagtgatactcctgcctcagcctcccgagtagctgggagtacaggtgcgcgccatcacgcccggctgattttttgtttgtttgtttgtttgtttaagtagagacagggtttcaccatgtcggacaggctggtcttgaactcttgacctcaggtgatctgcccacctcagcctcccaaagtgctggggttacaagtgtgagccactgagcccggctggaaaatttattttcagtctaaattgtgataaatgaaagtttcacagttttaagg

SEQ ID NO: 4987 - DNA, 556 bp, Homo sapiens
gctcttcgccatctttctttctccccggcagtagcagccatgaaggtcgagctgtgcagtttcagcgggtacaagatctacccaggacatgggaggcgctacgcccggaccgacgggaaggttttccagtttcttaacgcaaaatgtgagtcggcattcctttccaagaggaatcctcgtcagatcaactggactgtcctctacagaagaaaacacaaaaagggacagtcggaagaaattcaaaagaaaagaactcgccgtgcagtcaaattccaaagggccataactggtgcttctcttgctgatataatggccaagaggaatcagaaacctgaagttaggaaggctcaacgagaacaagctatcagggctgccaaggaagcaaaaaaggctaagcaagcatctaaaaagacagcaatggctgctgcaaaggctcccacaaaggcagcacctaagcaaaagattgtgaagcctgtgaaggtttctgctcctcgagttggtggaaaacgctaagtcggcagattggatttttgaataaagatctgactataaaaaa

SEQ ID NO: 4988 - DNA, 562 bp, Homo sapiens
ggctcttcgccatcttttctcttcccgtggagccgtcgccacgaaggtcgagctgtgcagttttagtgggtacaagatctacccgggacaggggaggcactacgccaggaccgacgggaaggttttcgagtttcttaatgcgaaatgcgagtcggcattcctttccaagaggaatccttggcagataaactggactgtcctccacagaaggaagcacaaaaagggagagtcggaagaaattcaaaagaaaagaacccacccagcagtcaaattccagagggccattactggtgcatctcttgctgatataatggccaagaggaatcagaaaccttaagttagaaaggctcaacgagaacaagctatcagggctgctaaggaagcaaaaaaggctaagcaagcatctaaaaagactgcaatggctactgctaaggcacctacaaaggcagcacctaagcaaaagattgtgaagcctgtgaaagtttcagctccccaagttggtggaaaacgctaaactggcagattagatttttaaataaagattggattatatttaaaaaaa

SEQ ID NO: 4989 - DNA, 692 bp, Homo sapiens
gcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaaaaaaaaaaaaaaaaaaaaaaaaaaaaaaaaaaaaa

SEQ ID NO: 4990 - DNA, 2199 bp, Homo sapiens; identical to SEQ ID NO: 4383

SEQ ID NO: 4991 - DNA, 315 bp, Homo sapiens
atggcaaaaatctccggccctacagagactgcgcggtgcattgagtccctgatagctgttttccagaagtatgctggaaaggatggttacaactgcaatctctccaagacggagttcccaagcttcatgaataaagagctggctgcctttacaaagaaccagaaggaccccggtgtccttgaccgcatgaagaaactggctgtcagcagcgatgggtagttagatttcccaaaatttcttaatctgattggtggcctagctgcggcttgccatgactccttcctcaaggctgtcccttcccagaagtggaactga

SEQ ID NO: 4992 - DNA, 378 bp, Homo sapiens
atggcaaaaatctccagccctacagagactgagcggtgcattgagtccctgattgctgttttccagaagtatgctggaaaggatggttacaaccgcaatctctccaagacggagttcctaagcttcatgaatacagagctggctgcctttacaaagaaccagaaggaccccggtgtccttgaccgcatgaagaaactggctgtcagcagcgatgggcagttagatttcccaaaatttcttaatctgattggtggcctagctgtggcttgccatgactccttcctcaaggctgtcccctcccagaagtagacctgaggaccccttgggcctggccttcaaacccaccccctttccttccagcctttctgtcatcatctc

SEQ ID NO: 4993 - DNA, 570 bp, Homo sapiens
gcgcacagagctctcagcgccgctcccagccacagcctcccgcgcctcgctcagctccaacatggcaaaaatctccagccctacagagactgagcggtgcattgagtccctgattgctgttttccagaagtatgctggaaaggatggttataactacactctctccaagacagagttcctaagcttcatgaatacagaactggctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaagaaaaaggaaaaagaatataaaca

SEQ ID NO: 4994 - DNA, 601 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaactagaga

SEQ ID NO: 4995 - DNA, 3896 bp, Homo sapiens
ctccaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttacttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaaccatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgcttgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacagggttgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcag

SEQ ID NO: 4996 - DNA, 3890 bp, Homo sapiens
atgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccatggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttgaagcgattcttgtgcctcagcttcccaagcagctgggattacaggtgcccgccaccacgcccagctaatttttgcatttttagtagagatgggtttcaccatgttggccatgctcgtctccaactcctgacctcaggtaatccgtctgccttggcctcccaaatgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaagatgctattcttc

SEQ ID NO: 4997 - DNA, 3849 bp, Homo sapiens
agcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttacttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaaccatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgcttgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacagggttgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcccctggtaaatatatttcaaaacttcagatgacaaggattagaacactcattaaagatgctattcttc

SEQ ID NO: 4998 - DNA, 744 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtatgcatggcttcctgcagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctga

SEQ ID NO: 4999 - DNA, 1414 bp, Homo sapiens
cccggccccacccccgagcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcaca

SEQ ID NO: 5000 - DNA, 1414 bp, Homo sapiens; identical to SEQ ID NO: 4999

SEQ ID NO: 5001 - DNA, 1414 bp, Homo sapiens; identical to SEQ ID NO: 4999

SEQ ID NO: 5002 - DNA, 1348 bp, Homo sapiens
caggtggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 5003 - DNA, 1414 bp, Homo sapiens; identical to SEQ ID NO: 4999

SEQ ID NO: 5004 - DNA, 1481 bp, Homo sapiens
acccccgagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgaggaaggttggtaattgtggctacttcatacaacagagttgagcattcattgtttagagtttgtgaatttcagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcaaaaaaaaaaaaaaaaaa

SEQ ID NO: 5005 - DNA, 1414 bp, Homo sapiens; identical to SEQ ID NO: 4999

SEQ ID NO: 5006 - DNA, 690 bp, Homo sapiens
ccgggcgctcctagcggtctcccggcccctgccgccctgccactatgtcccgccgctctatgctgcttgcctgggctcttcccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgt

SEQ ID NO: 5007 - DNA, 949 bp, Homo sapiens
acggcggggcgaagcgcccaggggcctgtgcgtccctccctgctgagcgagggggcctgtcattgccgtgggcgtgacccagaccccaaccacagtgcatcccgccctggcccagccagagaaggaagctgagtctggggtctgctgggccagcaggaagtcccagcagggtgtgaagcaagactttccgggccactcctggaatcccccagcagataaaggcggcccctccaccgggcgctcctagcggtctcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctc

SEQ ID NO: 5008 - DNA, 5363 bp, Homo sapiens
cagccggcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaaaaaaa

SEQ ID NO: 5009 - DNA, 3401 bp, Homo sapiens
gcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgcctgctccagcaagtagctactggttcacgtgcagtttggggctgtgaaacctaggcagaaggcggctgtctgagggctgtccccgcctaggacagggtcaatcgagg

SEQ ID NO: 5010 - DNA, 3401 bp, Homo sapiens; identical to SEQ ID NO: 5009

SEQ ID NO: 5011 - DNA, 5594 bp, Homo sapiens
gcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaatcagg

SEQ ID NO: 5012 - DNA, 3242 bp, Homo sapiens
ctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccc

SEQ ID NO: 5013 - DNA, 3381 bp, Homo sapiens
gcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttcaaaaaaa

SEQ ID NO: 5014 - DNA, 5461 bp, Homo sapiens
gtgtgtccctccagtgccgcttgccccttgttctcccaagcaccagggggacccctggtcttagattcaagttgcatcactagactaaccagctctgggaaccagagggacactggaggaactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgt

SEQ ID NO: 5015 - DNA, 5640 bp, Homo sapiens
caggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgt

SEQ ID NO: 5016 - DNA, 5498 bp, Homo sapiens
gtgtgtccctccagtgccgcttgccccttgttctcccaagcaccagggggacccctggtcttagattcaagttgcatcactagactaaccagctctgggaaccagagggacactggaggaactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgt

SEQ ID NO: 5017 - DNA, 5603 bp, Homo sapiens
caggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgt

SEQ ID NO: 5018 - DNA, 5546 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaaaaaaaaaaaaaaaaaaaa

SEQ ID NO: 5019 - DNA, 1282 bp, Homo sapiens
tcagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaag

SEQ ID NO: 5020 - DNA, 5509 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaaaaaaaaaaaaaaaaaaaa

SEQ ID NO: 5021 - DNA, 1330 bp, Homo sapiens
actgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaagg

SEQ ID NO: 5022 - DNA, 3090 bp, Homo sapiens
gaattccgggcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcacgggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 5023 - DNA, 1575 bp, Homo sapiens
gaagagctctggtctgcagctcccagtgagatcgatgcagaagacagaatcttgccgcatgacccaggctagaatgcagtggtgtgatctcggccctctgcaacctccacctcccagacgttcgccatattggccaggctggtctcaaactcctggcctcaagtgatctgcccacctcggcctcccaaagtgccagcagcatgctcggaggagtgactttaaagcttttctacttgcttcctagaactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaagg

SEQ ID NO: 5024 - DNA, 1207 bp, Homo sapiens
atgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagt

SEQ ID NO: 5025 - DNA, 3771 bp, Homo sapiens
atgctggggaagagccatggtagggccactcatggccctcttcctttggcggaccttggaatccaccttccctgcgttaaagtgctccaccaggtgacgccggaagagaagccagcaggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttgtaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaaggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagattggtccatgttgtgtgattcagtggtttgttccttcttatttctgaagagttttccattgtatgaatataccacaatttgtttcctccccaccagtttctgatactacaattaaaactgtctacatttacaa

SEQ ID NO: 5026 - DNA, 1194 bp, Homo sapiens
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 5027 - DNA, 972 bp, Homo sapiens
atggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 5028 - DNA, 1672 bp, Homo sapiens
ggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgagcaataatggggaatgagagcaacacaatgatctgaagaaaggacccccaacctctagggcgcaagactataatagttaaatttatatagatgaggctttcatttatgatatttctattttctcacacaactctcattccaaaaatattaaacaatcactcacgg

SEQ ID NO: 5029 - DNA, 8847 bp, Homo sapiens
gcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccatgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaatgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaa

SEQ ID NO: 5030 - DNA, 8404 bp, Homo sapiens
cgttgctgtcgggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccatgacgagaatgtgctcagctactacaggtaccagctgaagctctttgcccgcatgtgcttggaccgccagtacttggccatcgacgagatctcccagcagctgggtgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcccacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccctaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggttcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaacgtccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcaggggtctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttcg

SEQ ID NO: 5031 - DNA, 378 bp, Homo sapiens; identical to SEQ ID NO: 4992

SEQ ID NO: 5032 - DNA, 1607 bp, Homo sapiens
tgagatggagtctccctctgtcgcccaggctggagtgcagtggcatgatcttggctcactgcaatgcaacttctgactccctggttcaagcgattctcctgcctcagcctcccgagtagctgggattacaggtcaacatcagatttgaaatatttaaagtggatacaaaactatttcagcaatgcagacaattaagtgtgttgttgtgggcgatggtgctgttagtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaatgtgaaagaaaagtgggtgcctgagataactcaccactgtccaaagactccttttttgcttgttgggactcaaattgatctcagagatgacccctctactattgagaaacctgccaagaacaaacagaagcctatcactccagagactgctgaaaagctggcccgtgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttttgtttgtttgttttgtttaaaagcaaggcatgcttatggatgactctgtaacagactaattggaattgttgaagctgctccctggttccactctggagagtaatctgggacatcttagtgttttgttttgttttttttccctcctctttttttgggggggagtgtgtgtggggtttgttttttagtcttgtttttttaattcattaaccagtggttagcccttaaggggaggaggacggattgattccacattccatttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaa

SEQ ID NO: 5033 - DNA, 2275 bp, Homo sapiens
gcggccgcggcggggcggtggcaggagggcagctcgctggctgctcgcggcggtgcctgtccgagctcccctccgcgccggccgcgtcctctgggcggggtggccccgagccacggcctccaggctgctcttcctttcggaggtcgagttcctagcatttccatccgctcctccagcccgctccctgccggtttagctgaagcttccctttcggggagtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagcc

SEQ ID NO: 5034 - DNA, 1543 bp, Homo sapiens
ggggaacgccccggtggagaagctgaggtcaacatcagatttgaaatatttaaagtggatacaaaactatttcagcaatgcagacaattaagtgtgttgttgtgggcgatggtgctgttagtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaatgtgaaagaaaagtgggtgcctgagataactcaccactgtccaaagactccttttttgcttgttgggactcaaattgatctcagagatgacccctctactattgagaaacctgccaagaacaaacagaagcctatcactccagagactgctgaaaagctggcccgtgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttttgtttgtttgttttgtttaaaagcaaggcatgcttatggatgactctgtaacagactaattggaattgttgaagctgctccctggttccactctggagagtaatctgggacatcttagtgttttgttttgttttttttccctcctctttttttgggggggagtgtgtgtggggtttgttttttagtcttgtttttttaattcattaaccagtggttagcccttaaggggaggaggacggattgattccacattccatttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaatgaattgagtttgtaattaaaaaaatttttttccctttca

SEQ ID NO: 5035 - DNA, 1734 bp, Homo sapiens
ttccggttcccgcgcggcgctccaaagctcggggagtggtggtctccctttcctggagtcatttgtgggagttagggtcttatcctgatctttcctcgtcccccgctcccccgtcctccgaggtggcagctgcgtaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataagga

SEQ ID NO: 5036 - DNA, 1651 bp, Homo sapiens
ggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataagga

SEQ ID NO: 5037 - DNA, 2112 bp, Homo sapiens
ggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagcc

SEQ ID NO: 5038 - DNA, 2112 bp, Homo sapiens; identical to SEQ ID NO: 5037

SEQ ID NO: 5039 - DNA, 1734 bp, Homo sapiens; identical to SEQ ID NO: 5035

SEQ ID NO: 5040 - DNA, 595 bp, Homo sapiens
ggaattcgccaccatgcagacaattaagtgcgttgttgtgggcgatggtgccgttggtaaaacatgtctcctgatatcctacacaacaaacaaatttccatctgagtatgtaccgactgtttttgacaactatgcagtcacggttatgattggtggagagccatatacccttggactttttgatactgcagggcaagaggattatgacagattacgaccgctgagttatccacaaacagatgtatttctagtctgtttttcagtggtctctccatcctcatttgaaaatgtgaaggaaaagtgggtgcctgagataactcaccactgtccaaagactcctttcttgcttgttgggacccaaattgatctccgagatgacccctctactatcgagaaacttgccaagaacaaacagaagcctatcactccagagactgctgaaaagctggcccgtgacctgaaggcggtcaagtatgtggagtgttctgcactcacacagaaaggcctaaagaatgtatttgacgaagcaatattggctgccctggagcctccagaaccgaagaagagccgcaggtgtgtgctgctatgaggatcc

SEQ ID NO: 5041 - DNA, 1607 bp, Homo sapiens; identical to SEQ ID NO: 5032

SEQ ID NO: 5042 - DNA, 2112 bp, Homo sapiens; identical to SEQ ID NO: 5037

SEQ ID NO: 5043 - DNA, 1240 bp, Homo sapiens
atgaggacatttggaaaatgtcttgtagtggaaccaaagagagctgtttctagagaggattctgtaaagcccgttgcccatctaacagtgaagaaaatttttgttggtggtattaaagaagatacagaagaatataatttgagagactactttgaaaagtgtagcaagattgaaaccatagaagttatggaagacaggcagagtggaaaaaagagaggatttgcttttgtaacttttgatgatcatgatataattgataaaattgttgttcagaaataccacactattaatgggcataattgtgaagtgaaaaaggccctttctaaacaagagatgcagtctgctggatcacagagaggtcatggaggtggatctggcaattttatgggtcgcggaggaaactttggaggtgctggaggtaattttggccttggtggaaactttggtggaagaggaggctatggtggtggaggtggtggcagcagaggaagttatggaagaggtgatggtggatataatagatttggacgtgacggtggcaactatggtggtggtcctggttatagtagtagagggggctatggtggtggtggaacaggatatggaaaccaaggtggtggatatggtggaggtggtggaggatatgatggttacaatgaaggaggaaattttggcggtggtaactatggtggtggtgggaactataatgattttggaaatcatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcaaggagttgtcaggaaagctgcaggttacctcgagagagttgtcccaaatgcattagaggaactgtaaaaatctgccacagaaggaacaatgatccatagtcagaaaatttactgcagcttaaacaggaaacccttcttgttcaggactctcatagccacagtttgcaaaaagtgcagctattgattaatgcaatatagtgtcaactagatgtagattcctgaggtcttttatctgttgtagctttgtctttttctttttcttttcattacatcaggtatattgccctgtaaattgtggtagtggtaccaggaataaaaaattaaggaatttttaacttttca

SEQ ID NO: 5044 - DNA, 2924 bp, Homo sapiens
ctcggtcccatattgaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatattttt

SEQ ID NO: 5045 - DNA, 1137 bp, Homo sapiens
atggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagaaatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaa

SEQ ID NO: 5046 - DNA, 2924 bp, Homo sapiens; identical to SEQ ID NO: 5044

SEQ ID NO: 5047 - DNA, 1460 bp, Homo sapiens
atattgaactcgagttggaagaggcgagtctggtctcaaaatggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccgtgaaaggggacagttctggtggaagaagctcgggcagtccctatggtggtggttatggatctggtggtggaagtggtggatatggtagcagaaggttcgaaaaacagcagaaaagggctacagttcttagtaggagagagagcgaggagttgtcaggaaaactgcagcttactttgagacagtcctcccaaatgcattagaggaactgtaaaaatctgccacagaaggaacgatgatccatagtcagaaaagttattgcagcttaaacaggaaacccttcttgttcaggactgtcatagccacagtttgcaaaaagtgcagttattgattaatacaatgtagtgtcaattagatgtacattcctgaggtcttttatctgttgtagctttgtctttttctttttcttttcattacatcaagtatattgccctgtaaattgtggtagtggtaccaggaatgaaaaataaaggaatttttaacttttcaa

SEQ ID NO: 5048 - DNA, 5744 bp, Homo sapiens
atattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgtgtgtgttgttttgtcacttcacaatgttcatgtgacttaaacactataggtgaatattttgacttattttaccagtaagtaataaaacaacaggaaacttgga

SEQ ID NO: 5049 - DNA, 1878 bp, Homo sapiens
ggaagaggtgagtccggtctcaaaatggaggtaaaactgatgcccagtggccccaagcccaattccagctgtgaccgtcaccgccgggagcagaggatcatgatccaaaggaaccagagtagttgggaaaactgtttattggtgttctgagctttgaaacgacagatgatagtttaagagaacatttggaaaaatgggcacactcacagattgtatggtaatgagacacccccaaagaaaacgttccagggggtttggttttgtgacttactcttgtgttgaagaggtggatgcaacaacatgtgctcaaccacacaggttggtgggtgtctattggaaccaaagataactctttctagagaggagtcgataaagcctgatgcccatctaccagtgaagaaaaatttccttggtggtattaaagaagatacagaagaatataatttgagactactttgaaaagtatggcaagactgaaaccatggaagttatggaagacagacagagtgaaaaaaaggaaggatttgcttttgcaacttttgatgatcacgatacagttgataacattgttattcagaaataccacagttgataacattgttattcagaaataccacactattaatgggcataattgtgaagtgaaaaggccctttctaaacaagagatgcagtctgctggatcacagagagattgtggaggtggatctggcaattttatgggttgcggaggaaactttcgaggtggtggaggtaattttggccatggtggcaactttggtggaagaggaggctatgctggtggaggtggtggcagcggaaatagttatgaaggaggtgatggtggatataatggacttagaggcgacggtggcaactatgacagtcgtcctggttatagtagtagagggggctatggtggtggcggaccaggatatggaaaccaaggtggtagatatggtggtggtggtggaggatatgatggttgcaatggaggaaatttggtggtggtaactgtggtggtggtgggaactataatgattttggaaattatagtggacaacagcaatcaaattacgaacccatgtaagggggcagttttggtggaagaagctcatccctatgatggtggttatggatctggtgatggacatggtggatataggagcagaaggttttgaaaacagcagaaaagggctgcagctcttagcaggagagagagagaaattgttaggaaagctggaggttactttgagacagtcatcccaaatgcattaaaggaactttaaaaatctgccagagggaacaatgatccatagtcagaaaagttactgcagcttaaacaggaaaccttcttgttcaggactgccatagccatagtttgcaaaaagttcagctattgattaatgcgatgtagtgtcaattacatgtatactcctgaggtcttttatctgtggtagctttttcttcttctttttcttttcatttcatcaggtatattgccctgtaaattgcggtggtggtaacaggaataaaaaattaaggaatttttaacttttcaatatttgtgtagttcagtttttctacattttagtacagaaactaacaaaatgcagttttgaaggtgtttccttgtgagttaacaagatcattgttaattactattttgtatgaattttgctaaagttaactgtaaagaaacatttgctgacttgcaatgtaaggggaatctattctccccatttccaaaccatgacatgaatgggtgctgacgtgtggacagaatagatatttgtgtgtttgcaatgtgtgttttagataaataggattgggtatttaaattagcatttgtgaatttaatagcattaagattaccttc

SEQ ID NO: 5050 - DNA, 5687 bp, Homo sapiens
ctcggtcccatattgaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgtgtgtgttgttttgtcacttcacaatgttcatgtgacttaaacactataggtgaatattttgacttattttaccagtaagtaataaaacaacaggaaacttgga

SEQ ID NO: 5051 - DNA, 2981 bp, Homo sapiens
atattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatattttt

SEQ ID NO: 5052 - DNA, 11612 bp, Homo sapiens
acccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgccggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacgtgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccccgaccttttctggctcgtcttccgatacgtcaaccggggggccatgagtgtgagcgggcgggtctctgtgcgagaggagggcaggtcggccgcctgtgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggctgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccacgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctactgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcaccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccaccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaccgaatgaatgttgacttaaatacggagagagtctcaagacaggtctggaaccggcctggacagaggcaccaaactcttcctggggtgaccgttttccgttgttaggtcaaataactaactgtctctgggaccctacagcagctccccacgctagcacctgtccagccgaaactccctttgggcaaagaaactaagcgttggc

SEQ ID NO: 5053 - DNA, 11684 bp, Homo sapiens
acccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcggccacactggcgtcaccgcatactgcccacagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgccggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacgtgtgtgcccggtgcctacaacttcccctactgcgaaggtgactcctgtgagtcacaggcacaggttccctgtatgtgccgggctcacgtggaggggccgagctgtgaccgctgcaaacctgggttctggggactgagccccagcaaccccgagggctgtacccgtgagtgtgccctggagtattggggctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccccgaccttttctggctcgtcttccgatacgtcaaccggggggccatgagtgtgagcgggcgggtctctgtgcgagaggagggcaggtcggccgcctgtgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggctgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccacgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctactgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcaccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgtaggcgtcgggctgggagggatgcaccctggggagggttgcgcggggaggagggaggcctgctgggcgtaccccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcaccttccgcctcccacagagccagctccggagccccctgggcccccaccatgagacggcacagcagctggaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccgctgccctgggccctgatccctgcccggtctgctcctataggtgaccgtcgggttcagcggctgtgtgaagagactgaggctgcacgggaggcccctgggggcccccacacggatggcagggacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaccgaatgaatgttgacttaaatacggagagagtctcaagacaggtctggaaccggcctggacagaggcaccaaactcttcctggggtgaccgttttccgttgttaggtcaaataactaactgtctctgggaccctacagcagctccccacgctagcacctgtccagccgaaactccctttgggcaaagaaactaagcgttggc

SEQ ID NO: 5054 - DNA, 11612 bp, Homo sapiens; identical to SEQ ID NO: 5052

SEQ ID NO: 5055 - DNA, 11426 bp, Homo sapiens
agacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 5056 - DNA, 2514 bp, Homo sapiens
gtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaaaaaaaaaaaa

SEQ ID NO: 5057 - DNA, 2769 bp, Homo sapiens
aatgttttaagaaagtttacgaatcgtgtgccggaccgcgggttgaacaagcttcatctaaaacttccaggaatctctagacaggatcattgcttcccctctgctccagctctggttacagaaagctgagagtgactaggtctaggtgtttgtgtggggtggggtggggagatgcctcctctatcggactcagaggacgcgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacg

SEQ ID NO: 5058 - DNA, 2586 bp, Homo sapiens
cgcgccgggaacagccagtcggtgcctaacgcgagtgtatctcgagagagaagcgatcaacagctgccggtctgcgcctgcgcggcgacggggcgtggccgcgggcgagtggggccaaggaggcagccgggagcgggggcgcaggtgttactggttgcgtcgggtcacgtgggcgcgcagcagaccgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggcttcgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaggtcaaagaagatcctgatggtgaatgtgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcccgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaaaaaaaaaaaa

SEQ ID NO: 5059 - DNA, 2886 bp, Homo sapiens
aatgttttaagaaagtttacgaatcgtgtgccggaccgcgggttgaacaagcttcatctaaaacttccaggaatctctagacaggatcattgcttcccctctgctccagctctggttacagaaagctgagagtgactaggtctaggtgtttgtgtggggtggggtggggagatgcctcctctatcggactcagaggacgcgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacg

SEQ ID NO: 5060 - DNA, 2666 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcaggtgaggaaagggtgggggctggggacagagcccagcgggcaggggcggggtgagggtggagctacctcatgcctctcctccacccgtcactctccagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5061 - DNA, 2376 bp, Homo sapiens
ccggcgagaagtgtgaggccgcggtagggccgcatcccgctccggagagaagtctgagtccgccaggctctgcaggcccgcggaagctcgcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5062 - DNA, 2666 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5063 - DNA, 2399 bp, Homo sapiens
cccccgagaactcgggaagccggcgagaagtgtgaggccgcggtagggccgcatcccgctccggagagaagtctgagtccgccaggctctgcaggcccgcggaagctcgacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5064 - DNA, 2872 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagatggggtaacgcagctccgggctcccagcagaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgaggtggggccaagcctgggccgggggaccagggtgggggtggtactcaggagcctcacctggcccactgcctccccgaggacgaattcctccagaactcagacaagggtgacccctcacatgtggcccctgcaccacagaggcccaaggtcagttcctccaccttgcccctccctgcagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcaggtgaggaaagggtgggggctggggacagagcccagcgggcaggggcggggtgagggtggagctacctcatgcctctcctccacccgtcactctccagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5065 - DNA, 2650 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtaacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatggatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagccaaaaaaaaaaaaaaaaaaaa

SEQ ID NO: 5066 - DNA, 2756 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtcc

SEQ ID NO: 5067 - DNA, 2625 bp, Homo sapiens
  misc_feature (1)...(2625): n = A,T,C or G
agggacagcccagaggaggcgtggccacgctgccggcggaagtggagccctccgcgagcgcgcgaggccgccggggaggcggggaaaccggacagtaggggcggggcgggccggcgatggggatgcgggagcactacgcggagctgcacccgtgcccgccggaattggggatgcagagcagcggcagcgggtatggcaggcaccggcgggccggcctccagcgcaggtgcccgagaggcaggggctggcctgggatgcgcgcgcacctgccctcgccccgccccgcccgcacgaggggtggtggccgaggccccgccccgcacgcctcgccgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccacgtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctggcacccacctccacccccgccacggccaccctccttcccgccgcccgaccccgagtcgggaggactccgggaccattgacctcagctgcacattccnggccccgggctctggccaccttggcccgcccctcgctgctgctactacccgagcccagctacattcctcagctgccaagcactcgagaccatcttggcccctccagaccctgcctgagcctaggagcttgagtcacctcctccactcactccagcccaacagaaggaaggaggagggcgcccattcgtctgtcccagagcttattggccactgggtctcgctccgagtggggccagggtgggagggagggtcagggggaggaaaggggcgagcacccacgtgagagaatctgcctgtggccttgcccgccagcctcagtgccacttgacattccttgtcaccagcaacatctcgagccccctagatgtcccctgtcccaccaactctgcactccatggccaccccgtgccacccgtaggcagcctctctgctataagaaaagcagacgcagcagctgggaccccttccaacctcaatgccctgccattaaatccgcaaacagcc

SEQ ID NO: 5068 - DNA, 2968 bp, Homo sapiens
ggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgca

SEQ ID NO: 5069 - DNA, 3236 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcc

SEQ ID NO: 5070 - DNA, 3236 bp, Homo sapiens; identical to SEQ ID NO: 5069

SEQ ID NO: 5071 - DNA, 1462 bp, Homo sapiens
gcccgcgccgcgccgctctttctccgacagctgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttttgttcagtgtcaccttgtcagcaacactgtgtcccttcgccccaccgttcttctctgctgcatttggacatcagccaaatttgaacccaatcaaatataacgtgtctgacactgattttgtttttactcaataaatgtatagactacaaaaaaaaaaaaa

SEQ ID NO: 5072 - DNA, 1506 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttttgttcagtgtcaccttgtcagcaacactgtgtcccttcgccccaccgttcttctctgctgcatttggacatcagccaaatttgaacccaatcaaatataacgtgtctgacactgattttgtttttactcaataaatgtatagactacaaagc

SEQ ID NO: 5073 - DNA, 1506 bp, Homo sapiens; identical to SEQ ID NO: 5072

SEQ ID NO: 5074 - DNA, 2642 bp, Homo sapiens
tgggcagaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagaggtaagatgcttgtggtttggcccctttaaaaaaaatactagtccccatagtccagaagtttagtaattctgagaccatgtatggtgatgctttgttgttggtagcttggcagaaaggcacatgatttcagcagtctggaatgcaattcagtgtgtctgggcccaacgaaagcgcatacggaaaagtgattcctgactaacttattgttctggtctggagtctccggggaattgtagggaactttaccataaattgaatttaacagcagaaaatatgtatgagtttcaggcggtggtttggaatcttaactttatccccttctacctttctcttttggtgatctttgcagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgattt

SEQ ID NO: 5075 - DNA, 2293 bp, Homo sapiens
tgggcagaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgattt

SEQ ID NO: 5076 - DNA, 1935 bp, Homo sapiens
gggcgggcccaccgcgacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttctcattcttgaggagcattaaggtatttcgaaactgccaagggtgctggtgcggatggacactaatgcagccacgattggagaatacttgcttcatagtattggagcacatgttactgcttcattttggagcttgtggagttgatgacttctgttttctgtttgtaaattatttgctaagcatattttctctaggcttttttacttttggggttctacagtcgtaaaagagataataaggttagttgcacagtttaaagcttttattcgtccttacaaaagtaaatgggagggcattccatccccttccctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaaaaaaaa

SEQ ID NO: 5077 - DNA, 1848 bp, Homo sapiens
tgggcagaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaatgtctgtgagaggcagctatctgcactctaaactgcaaacagaaatcaggtgttttaagactgaa

SEQ ID NO: 5078 - DNA, 2487 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatatcctttgctggaaaacagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattcctttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctggg

SEQ ID NO: 5079 - DNA, 2033 bp, Homo sapiens
ggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaacggtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattcctttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagc

SEQ ID NO: 5080 - DNA, 2044 bp, Homo sapiens
ggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtgggaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattcctttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctggg

SEQ ID NO: 5081 - DNA, 2484 bp, Homo sapiens
agcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattcctttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctggg

SEQ ID NO: 5082 - DNA, 2129 bp, Homo sapiens
tctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcaaaaaaaaaaaaaaa

SEQ ID NO: 5083 - DNA, 2090 bp, Homo sapiens
gagaagcggcgtcggcggctggagcagaggcagcagccggaggagcagcagaggcggtcgggagcgatgaagatggcggcggggggcggcagaggcggcggtggcggctactaaggcggcggcagtgagggcggcggtgcccctaagctgctcaagactggcaacgccggcgaccagcacggaggcggcggcggcggcggtggcggtggaggaggcggggcggcgggggcggcggcggggagaactaccatgacctgcacaaaacccctgcctccccagttgtccacagcaggggcctgattgacgatgtggtggaagctgaccttgtggaggccttgcaggagtttggacccatcagctatgcggtggtaatgcctaaaaagagacaagcactggtggagtttgaagatgtgttgggggcttgcaacgccgtgagctacgcagccgacaaccaaatatacattgccggtcacccagcttttgtcaactactctaccagccagaagatctccctccccggggactcggatgactcccggagcgtgaacagtgtgcttctctttaccatcctgaaccccatttattcgatcaccacggatgttctttacactatctgtaatccttgtggccctgtccagagaattatcattttcaggaagaatggagttcaggcgatggtggaatttgactctgttcaaagtgcccagcgggccaaggcctctctcaatggggctggtatctattctggctgttgcactctgaagatggaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggccacgggcccccccgacctcactacgaagggagaaggatgggtccaccagtcgggggtcactgtcggggcccaagtcgctacggccccccagtatgggcaccccccaccccctcccccaccacccgagtatggccctcacgccgacagccctgtgctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtatttctctttcctttatgccattttttggtttttgtttttgttatttgcaaaagatcttgtattccttttttttttttttttttttttaatgctaggttcgtagaggcttaaccttaacggaaacgctggaagtctgcagggggagggagaggggaactgatatctcccaagattaaccttcactttaaaaaaattattgtacatgtgatttttttttcctgttcatacatttgtgctgcccatctactcctgggacatttcaataaaattgtttggaaaataaacacagcacttgctgggaaaaaaagaa

SEQ ID NO: 5084 - DNA, 1895 bp, Homo sapiens
ctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcaaaaaaaaaaaaaaa

SEQ ID NO: 5085 - DNA, 2666 bp, Homo sapiens; identical to SEQ ID NO: 5060

SEQ ID NO: 5086 - DNA, 2872 bp, Homo sapiens; identical to SEQ ID NO: 5064

SEQ ID NO: 5087 - DNA, 1425 bp, Homo sapiens
gcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcacagggcagtgtcttcattttgaccaggactgttggaagtatcctactgaattcccagctacagctaccctttcgtttaaatggtttttcagtttagagcagcctgatgg

SEQ ID NO: 5088 - DNA, 786 bp, Homo sapiens
atgttcgaggcgcgcctggtccagggctccatcctcaagaaggtgttggaggcactcaaggacctcatcaacgaggcctgctgggacattagctccagcggcgtaaacctgcagagcatggactcgtcccacgtctctttggtgcagctcaccctgcggtctgagggcttcgacacctaccgctgcgaccgcaacctggccatgggcgtgaacctcaccagtatgtccaaaatcctcaaatgcgccggcaatgaagatatcattacactaagggccgaagataacgcggataccttggcgctggtatttgaagcaccaaaccaggagaaagtttcagactatgaaatgaagttgatggacttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgctgatatgggacacttaaaatactacttggctcccaagatcgaggatgaagaaggatcttag

SEQ ID NO: 5089 - DNA, 1425 bp, Homo sapiens; identical to SEQ ID NO: 5087

SEQ ID NO: 5090 - DNA, 1460 bp, Homo sapiens
ggccggagctggcgccctggttctggaggtaaccggttactgagggcgagaagcgccacccggaggctctagcctgacaaatgcttgctgacctgggccagagctcttcccttacgcaagtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcacagggcagtgtcttcattttgaccaggactgttggaagtatcctactgaattcccagctacagctaccctttcgtttaaatggtttttcagtttagagcagcctgatgg

SEQ ID NO: 5091 - DNA, 5717 bp, Homo sapiens
ggatgaaaggtcatcctttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacattggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagctcgttctcct

SEQ ID NO: 5092 - DNA, 5717 bp, Homo sapiens; identical to SEQ ID NO: 5091

SEQ ID NO: 5093 - DNA, 4868 bp, Homo sapiens
gcggccgcgtctttgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattg

SEQ ID NO: 5094 - DNA, 2154 bp, Homo sapiens
gggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgtaggcaggagagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcatta

SEQ ID NO: 5095 - DNA, 2154 bp, Homo sapiens; identical to SEQ ID NO: 5094

SEQ ID NO: 5096 - DNA, 2202 bp, Homo sapiens
ggctgccccattgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 5097 - DNA, 2202 bp, Homo sapiens; identical to SEQ ID NO: 5096

SEQ ID NO: 5098 - DNA, 1395 bp, Homo sapiens
ggcggcggcggcggcggcggcggtcgaaagcggagtgaaagagggaggcagggagccggagagccggaaccggagtcgcagcggcggtaatagagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggttt

SEQ ID NO: 5099 - DNA, 1395 bp, Homo sapiens; identical to SEQ ID NO: 5098

SEQ ID NO: 5100 - DNA, 1998 bp, Homo sapiens
ctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggttt

SEQ ID NO: 5101 - DNA, 1344 bp, Homo sapiens
ggcggcggcggcggcggcggcggtcgaaagcggagtgaaagagggaggcagggagccggagagccggaaccggagtcgcagcggcggtaatagagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggccccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 5102 - DNA, 1429 bp, Homo sapiens
gccacgaaggccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5103 - DNA, 1647 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 5104 - DNA, 1650 bp, Homo sapiens
cagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 5105 - DNA, 1538 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 5106 - DNA, 3436 bp, Homo sapiens
gggaacggcgggagcagctgcggtcgcgcggagcgaggggagctggggaccgggcgggcccggggctgcgggaggcggcgccgccgcacaatcgccccggaatgcccgccagggcgcgcgtggggtgcggccgtccggccctgcaactcgagctgctgcccctggttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagtcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 5107 - DNA, 2871 bp, Homo sapiens
cgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccaccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 5108 - DNA, 3436 bp, Homo sapiens; identical to SEQ ID NO: 5106

SEQ ID NO: 5109 - DNA, 2871 bp, Homo sapiens; identical to SEQ ID NO: 5107

SEQ ID NO: 5110 - DNA, 3041 bp, Homo sapiens
cgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtcaggaggctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 5111 - DNA, 2912 bp, Homo sapiens
caaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgaaaaaaaaaaaaaaaaaaaaaaaaaaaaa

SEQ ID NO: 5112 - DNA, 3925 bp, Homo sapiens
ctaataatatacagacaccagctctgaggccagttaatcatccccagtgtccaggcacagagtagtcggtccgcctcacaatgttggactttctagctgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgacggagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtaaaaaaaaaaaaaaa

SEQ ID NO: 5113 - DNA, 4137 bp, Homo sapiens
ttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaa

SEQ ID NO: 5114 - DNA, 1860 bp, Homo sapiens
ttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatggtaattactgaagaggaaatactggtgtgtttggaatgtgtgcacaggttatttgaaaccttggaaactggcaggttaaaaagactttatgttctcattattgtatcctatgatattccatctttagtgttgctaataaagatctgaaggtt

SEQ ID NO: 5115 - DNA, 3273 bp, Homo sapiens
tgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggt

SEQ ID NO: 5116 - DNA, 3273 bp, Homo sapiens; identical to SEQ ID NO: 5115

SEQ ID NO: 5117 - DNA, 3273 bp, Homo sapiens; identical to SEQ ID NO: 5115

SEQ ID NO: 5118 - DNA, 1864 bp, Homo sapiens
gagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgaaaaaaaaaaaaaaaaaa

SEQ ID NO: 5119 - DNA, 3273 bp, Homo sapiens; identical to SEQ ID NO: 5115

SEQ ID NO: 5120 - DNA, 3273 bp, Homo sapiens; identical to SEQ ID NO: 5115

SEQ ID NO: 5121 - DNA, 3273 bp, Homo sapiens; identical to SEQ ID NO: 5115

SEQ ID NO: 5122 - DNA, 3273 bp, Homo sapiens; identical to SEQ ID NO: 5115

SEQ ID NO: 5123 - DNA, 4032 bp, Homo sapiens
gtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccatgttgttccaagagtacctggacatagaccagatgatcttcgacagagagctgccccaggcttctgggcttctccatcactgttgcttctacaagcgccggggacggaacctggtgacaatgaccacggctccccgtggtctgcaatcaggggaccgggccacctagtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaa

SEQ ID NO: 5124 - DNA, 2501 bp, Homo sapiens
gccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactacc

SEQ ID NO: 5125 - DNA, 2020 bp, Homo sapiens
tggcgggccgcagtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgaggtgatagtctttttcagaaagcccacggaagtgctttctcttctcacttaggttcatcttcctgtcccgtggaagtagatcaccaaagcactcctcaggcagaaggatgccatgactggcattgctttgctgtaaacagatccagcaaacctcacgttcctgtgttaaaccttgatgtttcctgttaggtgcatgccgtgataggggtgctgatggatgacacggatcccctggtcacagtgatgaaggtagaaaaggccccccaggagacctatgcagatattggggggttggacaaccaaattcaggaaattaaggtatgattgattggtaaccatctctgggtttcagttttggtttctgttgtcccatttaggatactttgcaggtgttttgtatgtttgcttatttattaatcaaaccagtagctgagtcagagcttgccagttgtggtatttttgtatttgttaatactgagttaggtgatagaaataacagtcagttgtgtgatagttcctgcagcagctgcagcttccttctttttagtgtaatgttgaatgcattgtctgtgtgaatatgtaatgtttctgattatgttgacttcagttgtgtttatctggaagcctccagtgctttgtggagatagcatgtgtatttgcacacatttagacagcagtggggttggagcataatcccagtgccttcagcagccctaggggctggaccatatgcagggcatatggtcattgaggatggccgtcggctctctgcatgatctttcatagggaagtcattccgagccatcacagatctctgctagggacctctgaggcagctgagaaatagctgtaatgtccctagatgggaacagccatcaggaagtctttcctagtcctatctgtagtttaattgaaaagggtcaacttgagctttattaagtctctcttgctcaagaagagctccaggctgacttctactagaaagtaaaaggggaattgggtgtggttagggagatggaacgggtgcggggaactcaagcaggacaggtgtcatcttcagtatgtctttgctgctaatagaaatcaagcacattgtctctaagaagagtaattgagatttttacttatttttgttgaaagcaagatattgtcatgttgccaattagtaaatatgctaataatttcagtaaagcctttcattcatactgtttttcataggaatctgtggagcttcctctcacccatcctgaatattatgaagagatgggtataaagcctcctaagggggtcattctctatggtccacctggcacaggtatgctctgtttttgacactttccaggcacccagctggtctcttgagcagcagcattggctagttataattactgaactaataagagaggacaccacaattccttagtttaaaacagggctgctcaaccttgtctgcatgttggaatcaccttgggagctttaaaaatactgatgg

SEQ ID NO: 5126 - DNA, 2100 bp, Homo sapiens
tggcgggccgcagtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacacttcctgtttctgcagtctccacacacacctaccgctcaacagcagcctgtgggtggacccagctacagggaagcctttggacaggaactcaggctgcggtcccaaggagtgtggacctcactatgcgttcgccacatcacacccccagagctggcgttcaacggtaattacagtgggaaatggtcactaccacagagccagggatattcgttgtttaaataataaaggctgcgttaatgtggctattgcttccaaaggaagtacagctttcctttttggaagttttgtggaccatgcatgttcttagcactctgagggcagaaaataactactggtgttcccaagagactgaggattcctagagatatcttgaaagcccttctgagcccttgggctcagaaatctcatccctttcaaggtgttcagaaacatgtcagaacttccccttccctttctccgtctatttccgtcatttctctttctgaacaaatcaggcctaaagctattaagtgggacagatcaaggtaagcgttcccttgacaggtggcctggtgtgggttgtagggcccacactgaatgaggagtgtgcattagttttctgttaatactataacaagttaccacaggc

SEQ ID NO: 5127 - DNA, 2229 bp, Homo sapiens
tggcgggccgcagtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacacttcctgtttctgcagtctccacacacacctaccgctcaacagcagcctgtgggtggacccagctacagggaagcctttggacaggaactcaggctgcggtcccaaggagtgtggacctcactatgcgttcgccacatcacacccccagagctggcgttcaacggtaattacagtgggaaatggtcactaccacagagccagggatattcgttgtttaaataataaaggctgcgttaatgtggctattgcttccaaaggaagtacagctttcctttttggaagttttgtggaccatgcatgttcttagcactctgagggcagaaaataactactggtgttcccaagagactgaggattcctagagatatcttgaaagcccttctgagcccttgggctcagaaatctcatccctttcaaggtgttcagaaacatgtcagaacttccccttccctttctccgtctatttccgtcatttctctttctgaacaaatcaggcctaaagctattaagtgggacagatcaaggtaagcgttcccttgacaggtggcctggtgtgggttgtagggcccacactgaatgaggagtgtgcattagttttctgttaatactataacaagttaccacaggc

SEQ ID NO: 5128 - DNA, 1576 bp, Homo sapiens
cttgagggctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagataagactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcagtccctgaaagggatgaggctgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacaaacaaaaa

SEQ ID NO: 5129 - DNA, 1442 bp, Homo sapiens
gggctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagataagactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcagtccctgaaagggatgaggctgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacaaacaaaaa

SEQ ID NO: 5130 - DNA, 1580 bp, Homo sapiens
gcacgacggtggttcgagcggccgaagcaagatgggtcaaagtcagagtggtggtcatggccctggaggtggcaagaaggatgacaaggacaagaaaaagaaatatgaacctcccgtaccaaccagagtggggaaaaagaagaagaaaacaaagggaccagatgctgcgagcaagcttccactggtgacacctcacactcaatgccggttaaaattattgaagttagagagaattaaagactatcttctcatggaggaagaattcattagaaatcaggaacaaatgaagcctttagaagaaaagcaagaggaggaaagatctaaggtggatgatctgaggggaaccccaatgtcagtaggaaccttggaagagatcattgatgacaatcatgccatcgtgtctacatctgtgggttcagaacactatgtcagcattctttcctttgtagacaaggatctgctggaaccaggctgctctgtcctgctcaaccacaaggtgcatgctgtcataggggtgctcatggatgacacagatcccttggtcacagtaatgaaggtagagaaggccccccaggaaacctacgctgatatcgggggattggacaaccaaatccaggaaattaaggaatccgtggagcttcctctcactcatcctgaatattatgaagagatgggtataaagcccccaaagggtgtcattctctatggtccacctggcacaggtaaaaccttattagccaaagcagtagcaaaccaaacctcagccactttcttgagagtggttggctctgaacttattcagaagtacctaggcgacgggcccaaactcgttcgggaattgttccgagttgcggaagaacatgcaccatccatcgtgtttattgatgaaatcgatgccattggaacaaaaagatacgactcaaattctggtggggagagggaaattcaacgaacgatgttggaactgttgaaccagttggatggatttgattcaaggggtgatgtgaaggtcatcatggccacaaaccggatagaaaccttggatccagcacttatcagaccaggccgcattgacaggaagattgagttccccctgcctgacgaaaagactaagaagcgcatctttcagatccacacaagcaggatgacgctggctgatgatgtgaccctggacgacttgatcatggctaaggatgacctctctggtgctgacatcaaggccatctgcacagaggctggtctgatggccttgagagagcgtcggatgaaagtaacaaatgaagacttcaagaaatctaaagaaaatgttctttataaaaaacaagagggcacccccgagggactgtatctctagcggaccagagctgccttcaaggagatggttgggcgtgtcctgacccctccgagggaggaggtgggggaagcccccggaggaaaccatgttccagttgatctttcttagcaaaacctcccgtgtacctttttgcgcgtgatgtgtaggacaccccctgggctgccttcctctgtgggtcacgtgcagtgctctgtccccaataaagcgtgctccccctccagcagtt

SEQ ID NO: 5131 - DNA, 1444 bp, Homo sapiens
tgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctg

SEQ ID NO: 5132 - DNA, 945 bp, Homo sapiens
ccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttggggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaa

SEQ ID NO: 5133 - DNA, 1752 bp, Homo sapiens
ccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggtaaggccgcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaa

SEQ ID NO: 5134 - DNA, 959 bp, Homo sapiens
ccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttggacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaa

SEQ ID NO: 5135 - DNA, 1754 bp, Homo sapiens
ccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaa

SEQ ID NO: 5136 - DNA, 2253 bp, Homo sapiens
aggcaaacacagccggaggtgagcacatacctgcttcgcaccccatgcgcctaaccacaaggttccctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcccagccggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagatggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaa

SEQ ID NO: 5137 - DNA, 3170 bp, Homo sapiens
gggccatgtgtgttagaattttatgtgaaattaacatttaattctcacggacacccctgaaacagatgccacagcccccattttgccaacgaggcagctgaggttcccagaggctcaataccagcaccatgagccgcagcacgcaaggcaaacacagccggagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtggaccggctttctgaaacatgggcatattctccgccacctgccccctactctcctcttatcccaggccggcgtcaggaggaggaacgcgcatcagttcccaagcagtaggaagaactggaaggccttgaaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctacaaa

SEQ ID NO: 5138 - DNA, 489 bp, Homo sapiens
atggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattag

SEQ ID NO: 5139 - DNA, 3180 bp, Homo sapiens
aggcaaacacagccggaggtgagcacatacctgcttcgcaccccatgcgcctaaccacaaggttccctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcccagccggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctacaaa

SEQ ID NO: 5140 - DNA, 2253 bp, Homo sapiens; identical to SEQ ID NO: 5136

SEQ ID NO: 5141 - DNA, 1881 bp, Homo sapiens
ggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggactctcttctctgacctgagtctcctttggaactctgcagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtga

SEQ ID NO: 5142 - DNA, 1840 bp, Homo sapiens
ggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtga

SEQ ID NO: 5143 - DNA, 1840 bp, Homo sapiens; identical to SEQ ID NO: 5142

SEQ ID NO: 5144 - DNA, 2028 bp, Homo sapiens
attaacccagaggggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggcaagttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcga

SEQ ID NO: 5145 - DNA, 1967 bp, Homo sapiens
caggagctgacacactatggcgcacgtccgaggcttgcagctgcctggctgcctggccctggctgccctgtgtagccttgtgcacagccagcatgcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctc

SEQ ID NO: 5146 - DNA, 2029 bp, Homo sapiens
attaacccagaggggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctc

SEQ ID NO: 5147 - DNA, 2819 bp, Homo sapiens
atgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaa

SEQ ID NO: 5148 - DNA, 2565 bp, Homo sapiens
atgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcagtggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaa

SEQ ID NO: 5149 - DNA, 2549 bp, Homo sapiens
ttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagccacaccgattggtgtccggctggtgacttgctggctatgaatgcccatttcccgtgggtccctggtttggtgtcctggccccagacaccctggctccctggacctcataggcagcccagatgctgggaggatgtgggctcagg

SEQ ID NO: 5150 - DNA, 1655 bp, Homo sapiens
atgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagccacaccgattggtgtccggctggtgacttgctggctatgaatgcccatttcccgtgggtccctggtttggtgtcctggccccagacaccctggctccctggacctcataggcagcccagatgctgggaggatgtgggctcagg

SEQ ID NO: 5151 - DNA, 1634 bp, Homo sapiens
gggggaggggcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaa

SEQ ID NO: 5152 - DNA, 1814 bp, Homo sapiens
caaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaa

SEQ ID NO: 5153 - DNA, 1423 bp, Homo sapiens
gcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaa

SEQ ID NO: 5154 - DNA, 1910 bp, Homo sapiens
gggctggtgggggaggggcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagccacaccgattggtgtccggctggtgacttgctggctatgaatgcccatttcccgtgggtccctggtttggtgtcctggccccagacaccctggctccctggacctcataggcagcccagatgctgggaggatgtgggctcagg

SEQ ID NO: 5155 - DNA, 1743 bp, Homo sapiens
gggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagccacaccgattggtgtccggctggtgacttgctggctatgaatgcccatttcccgtgggtccctggtttggtgtcctggccccagacaccctggctccctggacctcataggcagcccagatgctgggaggatgtgggctcagg

SEQ ID NO: 5156 - DNA, 1439 bp, Homo sapiens
ttccatttggctgcagcttctggagggagccgacaggagacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaa

SEQ ID NO: 5157 - DNA, 6686 bp, Homo sapiens
gcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctca

SEQ ID NO: 5158 - DNA, 6276 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattccccgggctgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggacttaggggttaccctggcttgagtggtgaaaaaggatcaccaggacagaagggaagccgaggcctggatggctatcaagggcctgatggaccccggggacctaagggagaagccggagacccagggccccctggactacctgcctactcccctcacccttccctagcaaaaggtgccagaggtgacccaggattcccaggggcccaaggggagccaggaagccagggtgagccaggagacccgggcctcccaggtccccctggcctctccattggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccccggaccaaaggggtggaaaggtgacgctggggaatgcagatgtacagaaggcgacgaagctatcaaaggtcttccaggactgccaggacccaagggcttcgcaggcatcaacggggagccggggaggaaaggggacaaaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggttatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggctttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttagaaaacactgataatcacactgcggtaggtcattcttttgccacatccctatagaccactgggtttggcaaaactcaggcagaagtggagacccttctagacatcactgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaaaaaaaaaaaaaaa

SEQ ID NO: 5159 - DNA, 6233 bp, Homo sapiens
cgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacctaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggctttatttttttcttaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaaccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatattttt

SEQ ID NO: 5160 - DNA, 6233 bp, Homo sapiens; identical to SEQ ID NO: 5159

SEQ ID NO: 5161 - DNA, 2329 bp, Homo sapiens
agcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcgtgagtgcgcccgcgcggggagggcggcggcggtggcaccggggagggccgggcccgggcccggccggccccaccgagggtctggctcctcttcggggcgtgtcctcggctcccaaagcccagccgtggttctcgagcccagcgccgggtgccggagaacgagggtgcgatgctggatggaggccggccgggtggggggagggcaggggccctcgacccttgaggaccccaggtcctaagcccggactctccaaagatttggaaaactttacaaaaccaagtggaatcaagcggataggctcagccagtactccactgtgcacagatccttggacccaggggctttgacaactgagaaacctagtttcttgattctagccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggaccctcaccccaggccgccctgtcttgggataattctgaatcaccgactcccgacacaagcgtttatcgaaggctttactgggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaccggcagtcctgccagctgttttggctagcc

SEQ ID NO: 5162 - DNA, 1646 bp, Homo sapiens
gctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaaaaaaaaaaaaaaaaaaaaaaaaaaaaaaaaaaaaaaaaaaaaa

SEQ ID NO: 5163 - DNA, 1574 bp, Homo sapiens
agcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtg

SEQ ID NO: 5164 - DNA, 1574 bp, Homo sapiens; identical to SEQ ID NO: 5163

SEQ ID NO: 5165 - protein, 9 aa, Homo sapiens
GICECGVCK

SEQ ID NO: 5166 - protein, 7 aa, Homo sapiens
VIPEYCR

SEQ ID NO: 5167 - protein, 9 aa, Homo sapiens
DLEGTYLCR

SEQ ID NO: 5168 - protein, 9 aa, Homo sapiens
ESNCYDPER

SEQ ID NO: 5169 - protein, 13 aa, Homo sapiens
GLPWSCSADEVQR

SEQ ID NO: 5170 - protein, 8 aa, Homo sapiens
TLEIEACR

SEQ ID NO: 5171 - protein, 14 aa, Homo sapiens
CYVDGSEEIGSDFK

SEQ ID NO: 5172 - protein, 20 aa, Homo sapiens
YCGTLLPNPVFSQNNELYLR

SEQ ID NO: 5173 - protein, 9 aa, Homo sapiens
TTEGCLNPR

SEQ ID NO: 5174 - protein, 10 aa, Homo sapiens
DGGVQACFSR

SEQ ID NO: 5175 - protein, 14 aa, Homo sapiens
KNILEESLCELVAK

SEQ ID NO: 5176 - protein, 21 aa, Homo sapiens
KPLHYAADCGQLEILEFLLLK

SEQ ID NO: 5177 - protein, 14 aa, Homo sapiens
VPTANVSVVDLTCR

SEQ ID NO: 5178 - protein, 16 aa, Homo sapiens
KYPLLLDVYAGPCSQK

SEQ ID NO: 5179 - protein, 8 aa, Homo sapiens
GLPFGCSK

SEQ ID NO: 5180 - protein, 15 aa, Homo sapiens
HSQTIDDPQCPSGTK

SEQ ID NO: 5181 - protein, 8 aa, Homo sapiens
FVPDECPR

SEQ ID NO: 5182 - protein, 11 aa, Homo sapiens
LVECLETVLNK

SEQ ID NO: 5183 - protein, 18 aa, Homo sapiens
AIGAVPLIQGEYMIPCEK

SEQ ID NO: 5184 - protein, 16 aa, Homo sapiens
SNIWVAGDAACFYDIK

SEQ ID NO: 5185 - protein, 12 aa, Homo sapiens
LQVFPAGPQCSK

SEQ ID NO: 5186 - protein, 7 aa, Homo sapiens
CFCPSPR

SEQ ID NO: 5187 - protein, 16 aa, Homo sapiens
HHPTTLAVGICSPASR

SEQ ID NO: 5188 - protein, 12 aa, Homo sapiens
ALASTCKPELQK

SEQ ID NO: 5189 - protein, 10 aa, Homo sapiens
TCSLPGTALK

SEQ ID NO: 5190 - protein, 11 aa, Homo sapiens
MDCQECPEGYR

SEQ ID NO: 5191 - protein, 19 aa, Homo sapiens
EHINLGCDMDFDIAGPSIR

SEQ ID NO: 5192 - protein, 24 aa, Homo sapiens
GDLENAFLNLVQCIQNKPLYFADR

SEQ ID NO: 5193 - protein, 13 aa, Homo sapiens
LSFHQGCTIASQR

SEQ ID NO: 5194 - protein, 9 aa, Homo sapiens
GDFCIQVGR

SEQ ID NO: 5195 - protein, 14 aa, Homo sapiens
VQNVCAQGEDILNK

SEQ ID NO: 5196 - protein, 11 aa, Homo sapiens
AHVVPCFDASK

SEQ ID NO: 5197 - protein, 23 aa, Homo sapiens
SLDGIPFTVDAGGLIHCIEDFHK

SEQ ID NO: 5198 - protein, 12 aa, Homo sapiens
SCAVAEYGVYVK

SEQ ID NO: 5199 - protein, 13 aa, Homo sapiens
CLFASGSPFGPVK

SEQ ID NO: 5200 - protein, 14 aa, Homo sapiens
DSPIQCIQAIAENR

SEQ ID NO: 5201 - protein, 12 aa, Homo sapiens
KGCPPDDIENPR

SEQ ID NO: 5202 - protein, 16 aa, Homo sapiens
LILADALCYAHTFNPK

SEQ ID NO: 5203 - protein, 11 aa, Homo sapiens
NIVSDCSAFVK

SEQ ID NO: 5204 - protein, 28 aa, Homo sapiens
GGHFCGATLIAPNFVMSAAHCVANVNVR

SEQ ID NO: 5205 - protein, 16 aa, Homo sapiens
DKLPQPVQPDPVSHCK

SEQ ID NO: 5206 - protein, 9 aa, Homo sapiens
VTLNGVPCK

SEQ ID NO: 5207 - protein, 9 aa, Homo sapiens
RSNVCTLVR

SEQ ID NO: 5208 - protein, 19 aa, Homo sapiens
TCPANPGAVCADSTSGLSR

SEQ ID NO: 5209 - protein, 17 aa, Homo sapiens
DAPEGGFDAVLQAAVCK

SEQ ID NO: 5210 - protein, 8 aa, Homo sapiens
CLSVMEAK

SEQ ID NO: 5211 - protein, 25 aa, Homo sapiens
KGGSYTQAASSDSAQGSDVSLTACK

SEQ ID NO: 5212 - protein, 16 aa, Homo sapiens
VSPPGVLCLPVLNIPR

SEQ ID NO: 5213 - protein, 30 aa, Homo sapiens
ALGALVDSCAPGLCPDWESWDPQKPVDNAR

SEQ ID NO: 5214 - protein, 20 aa, Homo sapiens
HSATTVFGANTPIVSCNFDR

SEQ ID NO: 5215 - protein, 23 aa, Homo sapiens
SCLITFKPGAFIPGVPVQPVLLR

SEQ ID NO: 5216 - protein, 21 aa, Homo sapiens
ESSFDAVFLDPFDNCGLIVAK

SEQ ID NO: 5217 - protein, 10 aa, Homo sapiens
LFCIPVHGIR

SEQ ID NO: 5218 - protein, 9 aa, Homo sapiens
YCDPNLGLR

SEQ ID NO: 5219 - protein, 20 aa, Homo sapiens
CAEGYALYAQALTDQQQFGK

SEQ ID NO: 5220 - protein, 10 aa, Homo sapiens
STLTDSLVCK

SEQ ID NO: 5221 - protein, 11 aa, Homo sapiens
GLCVATPVQLR

SEQ ID NO: 5222 - protein, 19 aa, Homo sapiens
LSCAASGFTFDDYSMHWVR

SEQ ID NO: 5223 - protein, 9 aa, Homo sapiens
LACLAGELR

SEQ ID NO: 5224 - protein, 9 aa, Homo sapiens
RRPYGCVLR

SEQ ID NO: 5225 - protein, 10 aa, Homo sapiens
ALLYLCGGDD

SEQ ID NO: 5226 - protein, 9 aa, Homo sapiens
ANLCTLAEK

SEQ ID NO: 5227 - protein, 12 aa, Homo sapiens
IVCGHPEGGGLK

SEQ ID NO: 5228 - protein, 23 aa, Homo sapiens
SSFATPGVNVGLFCSTPGVALAR

SEQ ID NO: 5229 - protein, 9 aa, Homo sapiens
YICYAEQTR

SEQ ID NO: 5230 - protein, 10 aa, Homo sapiens
TPTLTSIYCR

SEQ ID NO: 5231 - protein, 9 aa, Homo sapiens
SLLDACESR

SEQ ID NO: 5232 - protein, 20 aa, Homo sapiens
FFSASCVPGADKGQFPNLCR

SEQ ID NO: 5233 - protein, 9 aa, Homo sapiens
AFCGFEDPR

SEQ ID NO: 5234 - protein, 7 aa, Homo sapiens
CLTAIVK

SEQ ID NO: 5235 - protein, 25 aa, Homo sapiens
YVEPIEDVPCGNIVGLVGVDQFLVK

SEQ ID NO: 5236 - protein, 24 aa, Homo sapiens
CSYQPTMEGVHTVHVTFAGVPIPR

SEQ ID NO: 5237 - protein, 12 aa, Homo sapiens
GVLLYGPPGCGK

SEQ ID NO: 5238 - protein, 14 aa, Homo sapiens
VGPLLACIIGTQFR

SEQ ID NO: 5239 - protein, 8 aa, Homo sapiens
VIECDVVK

SEQ ID NO: 5240 - protein, 19 aa, Homo sapiens
TFCIPHGGGGPGMGPIGVK

SEQ ID NO: 5241 - protein, 11 aa, Homo sapiens
EAVCEVALDYK

SEQ ID NO: 5242 - protein, 12 aa, Homo sapiens
LLGNVLVCVLAR

SEQ ID NO: 5243 - protein, 10 aa, Homo sapiens
ALFLLPCISR

SEQ ID NO: 5244 - protein, 21 aa, Homo sapiens
GALILSNVQPSDTMVTQCEAR

SEQ ID NO: 5245 - protein, 16 aa, Homo sapiens
LIGPNCPGVINPGECK

SEQ ID NO: 5246 - protein, 13 aa, Homo sapiens
DLLVQQASQCLSK

SEQ ID NO: 5247 - protein, 25 aa, Homo sapiens
TGQATVASGIPAGWMGLDCGPESSK

SEQ ID NO: 5248 - protein, 11 aa, Homo sapiens
HYCTVANPVSR

SEQ ID NO: 5249 - protein, 15 aa, Homo sapiens
VACITEQVLTLVNKR

SEQ ID NO: 5250 - protein, 10 aa, Homo sapiens
CLLELDQQIK

SEQ ID NO: 5251 - protein, 20 aa, Homo sapiens
SPVGVQPILNEHTFCAGMSK

SEQ ID NO: 5252 - protein, 16 aa, Homo sapiens
AITIASQTNCPLYVTK

SEQ ID NO: 5253 - protein, 21 aa, Homo sapiens
LTESPCALVASQYGWSGNMER

SEQ ID NO: 5254 - protein, 23 aa, Homo sapiens
AFTKPEEACSFILSADFPALVVK

SEQ ID NO: 5255 - protein, 12 aa, Homo sapiens
DFTPVCTTELGR

SEQ ID NO: 5256 - protein, 8 aa, Homo sapiens
NLETPLCK

SEQ ID NO: 5257 - protein, 16 aa, Homo sapiens
WLLLCNPGLADTIVEK

SEQ ID NO: 5258 - protein, 15 aa, Homo sapiens
AVQALCAVYEHWVPR

SEQ ID NO: 5259 - protein, 16 aa, Homo sapiens
LIASYCNVGDIEGASK

SEQ ID NO: 5260 - protein, 27 aa, Homo sapiens
SHCIAEVENDEMPADLPSLAADFVESK

SEQ ID NO: 5261 - protein, 12 aa, Homo sapiens
ILCFYGPPGVGK

SEQ ID NO: 5262 - protein, 28 aa, Homo sapiens
LLSHCLLVTLAAHLPAEFTPAVHASLDK

SEQ ID NO: 5263 - protein, 17 aa, Homo sapiens
VIVVGNPANTNCLTASK

SEQ ID NO: 5264 - protein, 11 aa, Homo sapiens
CCSGAIIVLTK

SEQ ID NO: 5265 - protein, 10 aa, Homo sapiens
YQTNPCIGYK

SEQ ID NO: 5266 - protein, 17 aa, Homo sapiens
CDRVDQLTAQLADLAAR

SEQ ID NO: 5267 - protein, 19 aa, Homo sapiens
QAVLGAGLPISTPCTTINK

SEQ ID NO: 5268 - protein, 16 aa, Homo sapiens
FSNNPALCNVESIQWR

SEQ ID NO: 5269 - protein, 14 aa, Homo sapiens
CEFQDAYVLLSEKK

SEQ ID NO: 5270 - protein, 16 aa, Homo sapiens
YADLTEDQLPSCESLK

SEQ ID NO: 5271 - protein, 23 aa, Homo sapiens
ISGNLDAPEGGFDAILQTAVCTR

SEQ ID NO: 5272 - protein, 14 aa, Homo sapiens
ATDCVGHDVVTLLR

SEQ ID NO: 5273 - protein, 24 aa, Homo sapiens
LLQEGQALEYVCPSGFYPYPVQTR

SEQ ID NO: 5274 - protein, 22 aa, Homo sapiens
LQAAQLPHTGVFGQSFSCPSDR

SEQ ID NO: 5275 - protein, 15 aa, Homo sapiens
TVIEQQPVLCEVFCR

SEQ ID NO: 5276 - protein, 21 aa, Homo sapiens
FGSYCPTTCGIADFLSTYQTK

SEQ ID NO: 5277 - protein, 18 aa, Homo sapiens
SCSPYNSFIVVSMLSAIR

SEQ ID NO: 5278 - protein, 9 aa, Homo sapiens
LQLEACETR

SEQ ID NO: 5279 - protein, 20 aa, Homo sapiens
GKSPSDCCHNQCAAGCTGPR

SEQ ID NO: 5280 - protein, 19 aa, Homo sapiens
CHDYYTTEFLYNLYSSEGK

SEQ ID NO: 5281 - protein, 18 aa, Homo sapiens
ADMGGAATICSAIVSAAK

SEQ ID NO: 5282 - protein, 9 aa, Homo sapiens
VSPTPGCIR

SEQ ID NO: 5283 - protein, 14 aa, Homo sapiens
GGGGGPCGFQPASR

SEQ ID NO: 5284 - protein, 22 aa, Homo sapiens
NEDFAAHPGEDAVPTGPDCQAK

SEQ ID NO: 5285 - protein, 9 aa, Homo sapiens
YTCLPGYVR

SEQ ID NO: 5286 - protein, 15 aa, Homo sapiens
ELETVCNDVLSLLDK

SEQ ID NO: 5287 - protein, 8 aa, Homo sapiens
EVPGPDCR

SEQ ID NO: 5288 - protein, 9 aa, Homo sapiens
DYFMPCPGR

SEQ ID NO: 5289 - protein, 10 aa, Homo sapiens
CRPVNQEIVR

SEQ ID NO: 5290 - protein, 15 aa, Homo sapiens
MADCGGLPQISQPAK

SEQ ID NO: 5291 - protein, 16 aa, Homo sapiens
ETVYCLNDDDETEVLK

SEQ ID NO: 5292 - protein, 12 aa, Homo sapiens
ASVGFGGSCFQK

SEQ ID NO: 5293 - protein, 9 aa, Homo sapiens
VPLDVACAR

SEQ ID NO: 5294 - protein, 11 aa, Homo sapiens
NLSGQPNFPCR

SEQ ID NO: 5295 - protein, 9 aa, Homo sapiens
SSVLGFACK

SEQ ID NO: 5296 - protein, 6 aa, Homo sapiens
VVDLCR

SEQ ID NO: 5297 - protein, 15 aa, Homo sapiens
DSFSDPYAHICFLHR

SEQ ID NO: 5298 - protein, 9 aa, Homo sapiens
NYLCIEEEK

SEQ ID NO: 5299 - protein, 7 aa, Homo sapiens
CGLVIGK

SEQ ID NO: 5300 - protein, 21 aa, Homo sapiens
APPAPALTLAPVPSQYLCTPR

SEQ ID NO: 5301 - protein, 7 aa, Homo sapiens
AVVVCPK

SEQ ID NO: 5302 - protein, 19 aa, Homo sapiens
ATCAPQHGAPGPGPADASK

SEQ ID NO: 5303 - protein, 10 aa, Homo sapiens
LTLSCEEFVK

SEQ ID NO: 5304 - protein, 14 aa, Homo sapiens
AHGQDLGTAGSCLR

SEQ ID NO: 5305 - protein, 16 aa, Homo sapiens
EVICQVLHLGTVTDFK

SEQ ID NO: 5306 - protein, 13 aa, Homo sapiens
DLLFRDDTVCLAK

SEQ ID NO: 5307 - protein, 12 aa, Homo sapiens
KGDECELLGHSK

SEQ ID NO: 5308 - protein, 9 aa, Homo sapiens
CMPTFQFFK

SEQ ID NO: 5309 - protein, 7 aa, Homo sapiens
LPGCLPR

SEQ ID NO: 5310 - protein, 11 aa, Homo sapiens
VGAPLVCCEIK

SEQ ID NO: 5311 - protein, 16 aa, Homo sapiens
CQGRTVPLAVLQLRVK

SEQ ID NO: 5312 - protein, 14 aa, Homo sapiens
CSGVEGQDVVQLLR

SEQ ID NO: 5313 - protein, 15 aa, Homo sapiens
KFTTDDSICVLGISK

SEQ ID NO: 5314 - protein, 22 aa, Homo sapiens
LVRPEVDVMCTAFHDNEETFLK

SEQ ID NO: 5315 - protein, 16 aa, Homo sapiens
APSVANVGSHCDLSLK

SEQ ID NO: 5316 - protein, 12 aa, Homo sapiens
GRLPLLAVCDYK

SEQ ID NO: 5317 - protein, 19 aa, Homo sapiens
EIYCPAPPQIDNGIIQGER

SEQ ID NO: 5318 - protein, 6 aa, Homo sapiens
YVICVR

SEQ ID NO: 5319 - protein, 12 aa, Homo sapiens
YHTVNGHNCEVR

SEQ ID NO: 5320 - protein, 30 aa, Homo sapiens
VGEAGLLSVNCSEAGPGALGLEAVSDSGTK

SEQ ID NO: 5321 - protein, 12 aa, Homo sapiens
CEASGKPEVQFR

SEQ ID NO: 5322 - protein, 17 aa, Homo sapiens
LEICNLTPDTLTSDTYK

SEQ ID NO: 5323 - protein, 7 aa, Homo sapiens
IFTFICK

SEQ ID NO: 5324 - protein, 25 aa, Homo sapiens
VVTTPAFMCETALHYIHDGIGAMVR

SEQ ID NO: 5325 - protein, 14 aa, Homo sapiens
VKCSGPGLSPGMVR

SEQ ID NO: 5326 - protein, 11 aa, Homo sapiens
FFLCQVAGDAK

SEQ ID NO: 5327 - protein, 14 aa, Homo sapiens
DIASGLIGPLIICK

SEQ ID NO: 5328 - protein, 17 aa, Homo sapiens
AAFGLSEAGFNTACVTK

SEQ ID NO: 5329 - protein, 17 aa, Homo sapiens
CPSIAAAIAAVNALHGR

SEQ ID NO: 5330 - protein, 13 aa, Homo sapiens
RIAVNDVTITCQR

SEQ ID NO: 5331 - protein, 12 aa, Homo sapiens
VVCGMFGFPGER

SEQ ID NO: 5332 - protein, 12 aa, Homo sapiens
AYLEGTCVEWLR

SEQ ID NO: 5333 - protein, 19 aa, Homo sapiens
HCECSTDEVNSEDMDAYCR

SEQ ID NO: 5334 - protein, 13 aa, Homo sapiens
YNPNVLPVQCTGK

SEQ ID NO: 5335 - protein, 15 aa, Homo sapiens
HGTCAAQVDALNSQK

SEQ ID NO: 5336 - protein, 15 aa, Homo sapiens
NSLCIENSCIAAHDK

SEQ ID NO: 5337 - protein, 19 aa, Homo sapiens
LATHPSCNNEHVIVFNGIR

SEQ ID NO: 5338 - protein, 19 aa, Homo sapiens
AILQHLGLESTCDDSIIVK

SEQ ID NO: 5339 - protein, 22 aa, Homo sapiens
DGTVLCELINALYPEGQAPVKK

SEQ ID NO: 5340 - protein, 12 aa, Homo sapiens
DACVISSDFHER

SEQ ID NO: 5341 - protein, 12 aa, Homo sapiens
YICENQDSISSK

SEQ ID NO: 5342 - protein, 9 aa, Homo sapiens
IICQGFTGK

SEQ ID NO: 5343 - protein, 21 aa, Homo sapiens
HIDCAHVYQNENEVGVAIQEK

SEQ ID NO: 5344 - protein, 10 aa, Homo sapiens
DCLTESNLIK

SEQ ID NO: 5345 - protein, 28 aa, Homo sapiens
YASICQQNGIVPIVEPEILPDGDHDLKR

SEQ ID NO: 5346 - protein, 24 aa, Homo sapiens
AYHEQLSVAEITNACFEPANQMVK

SEQ ID NO: 5347 - protein, 14 aa, Homo sapiens
NHIMHLEEHLLCHR

SEQ ID NO: 5348 - protein, 14 aa, Homo sapiens
VACITEQVLTLVNK

SEQ ID NO: 5349 - protein, 18 aa, Homo sapiens
ILLTCSLNDSATEVTGHR

SEQ ID NO: 5350 - protein, 12 aa, Homo sapiens
HQLDEIICWLTK

SEQ ID NO: 5351 - protein, 26 aa, Homo sapiens
ESTVFEDLSDEAERDEYELLCPDNTR

SEQ ID NO: 5352 - protein, 16 aa, Homo sapiens
ACHLVHDFTDAVIQER

SEQ ID NO: 5353 - protein, 14 aa, Homo sapiens
HELQANCYEEVKDR

SEQ ID NO: 5354 - protein, 20 aa, Homo sapiens
SITIIGGGFLGSELACALGR

SEQ ID NO: 5355 - protein, 9 aa, Homo sapiens
HICYFQIDK

SEQ ID NO: 5356 - protein, 20 aa, Homo sapiens
NMVHPNVICDGCNGPVVGTR

SEQ ID NO: 5357 - protein, 11 aa, Homo sapiens
GIYAVGDVCGK

SEQ ID NO: 5358 - protein, 18 aa, Homo sapiens
YKPVTNQVECHPYLTQEK

SEQ ID NO: 5359 - protein, 8 aa, Homo sapiens
VCTNIIEK

SEQ ID NO: 5360 - protein, 9 aa, Homo sapiens
SCPNPGEIR

SEQ ID NO: 5361 - protein, 9 aa, Homo sapiens
CDDLEALKK

SEQ ID NO: 5362 - protein, 9 aa, Homo sapiens
INCEGTIPR

SEQ ID NO: 5363 - protein, 8 aa, Homo sapiens
ICQIVSTR

SEQ ID NO: 5364 - protein, 13 aa, Homo sapiens
QNFIDPLQNLCEK

SEQ ID NO: 5365 - protein, 19 aa, Homo sapiens
CTIQVTHLAQEFPEIIIQK

SEQ ID NO: 5366 - protein, 15 aa, Homo sapiens
FNAHGDANTIVCNSK

SEQ ID NO: 5367 - protein, 10 aa, Homo sapiens
CQYYSVSFSK

SEQ ID NO: 5368 - protein, 12 aa, Homo sapiens
TCLHAILNILEK

SEQ ID NO: 5369 - protein, 14 aa, Homo sapiens
STVISYECCPGYEK

SEQ ID NO: 5370 - protein, 11 aa, Homo sapiens
SFPCFDEPNKK

SEQ ID NO: 5371 - protein, 20 aa, Homo sapiens
YCGTDMPHPITSFSSALTLR

SEQ ID NO: 5372 - protein, 16 aa, Homo sapiens
CLELFSELAEDKENYK

SEQ ID NO: 5373 - protein, 12 aa, Homo sapiens
GFPCSLEHTFSR

SEQ ID NO: 5374 - protein, 16 aa, Homo sapiens
RPCFSALEVDETYVPK

SEQ ID NO: 5375 - protein, 14 aa, Homo sapiens
NNTCFVDAVAELAR

SEQ ID NO: 5376 - protein, 11 aa, Homo sapiens
LQIQCVVEDDK

SEQ ID NO: 5377 - protein, 17 aa, Homo sapiens
AGKPVICATQMLESMIK

SEQ ID NO: 5378 - protein, 8 aa, Homo sapiens
VFFPLCGK

SEQ ID NO: 5379 - protein, 21 aa, Homo sapiens
DGSCGVAYVVQEPGDYEVSVK

SEQ ID NO: 5380 - protein, 12 aa, Homo sapiens
LLDLLHLQLICR

SEQ ID NO: 5381 - protein, 10 aa, Homo sapiens
ADQLCQQELR

SEQ ID NO: 5382 - protein, 14 aa, Homo sapiens
GQTSPGNCVLLDPK

SEQ ID NO: 5383 - protein, 13 aa, Homo sapiens
EECDKYALQSQQR

SEQ ID NO: 5384 - protein, 8 aa, Homo sapiens
VLNVPLCK

SEQ ID NO: 5385 - protein, 11 aa, Homo sapiens
AVLFCLSEDKK

SEQ ID NO: 5386 - protein, 8 aa, Homo sapiens
LTCLQNLK

SEQ ID NO: 5387 - protein, 12 aa, Homo sapiens
LVMSYVAAVCGK

SEQ ID NO: 5388 - protein, 16 aa, Homo sapiens
YKPVCNQVECHPYFNR

SEQ ID NO: 5389 - protein, 17 aa, Homo sapiens
THEAEIVEGENHTYCIR

SEQ ID NO: 5390 - protein, 16 aa, Homo sapiens
TYLGNALVCTCYGGSR

SEQ ID NO: 5391 - protein, 13 aa, Homo sapiens
NLALCPANHAPLR

SEQ ID NO: 5392 - protein, 14 aa, Homo sapiens
CLDANEAEPVFDER

SEQ ID NO: 5393 - protein, 22 aa, Homo sapiens
RMPCAEDYLSVVLNQLCVLHEK

SEQ ID NO: 5394 - protein, 13 aa, Homo sapiens
VFANPEDCVAFGK

SEQ ID NO: 5395 - protein, 8 aa, Homo sapiens
LCTVATLR

SEQ ID NO: 5396 - protein, 10 aa, Homo sapiens
ASPFLECHGR

SEQ ID NO: 5397 - protein, 17 aa, Homo sapiens
FNVEKPLIFNTYQCYLK

SEQ ID NO: 5398 - protein, 12 aa, Homo sapiens
LQDLSSCITQGK

SEQ ID NO: 5399 - protein, 23 aa, Homo sapiens
FPHLQNCLAGGESLLPETLENWR

SEQ ID NO: 5400 - protein, 24 aa, Homo sapiens
EDDGVPVICQVEHPAVTGNLQTQR

SEQ ID NO: 5401 - protein, 14 aa, Homo sapiens
AFTGRFLCNMTFLK

SEQ ID NO: 5402 - protein, 23 aa, Homo sapiens
IFTENIVEQPCPDVFWFPIFSEK

SEQ ID NO: 5403 - protein, 14 aa, Homo sapiens
CISDLSLHVATTEK

SEQ ID NO: 5404 - protein, 13 aa, Homo sapiens
IIYGGSVTGATCK

SEQ ID NO: 5405 - protein, 9 aa, Homo sapiens
TAVCDIPPR

SEQ ID NO: 5406 - protein, 13 aa, Homo sapiens
AVTLECVSAGEPR

SEQ ID NO: 5407 - protein, 18 aa, Homo sapiens
VAHALAEGLGVIACIGEK

SEQ ID NO: 5408 - protein, 11 aa, Homo sapiens
VQSLCYLQLTR

SEQ ID NO: 5409 - protein, 19 aa, Homo sapiens
LLEAQACTGGIIDPSTGER

SEQ ID NO: 5410 - protein, 18 aa, Homo sapiens
GLELQPQDNNGLCDPYIK

SEQ ID NO: 5411 - protein, 11 aa, Homo sapiens
NCQTLVNLCSR

SEQ ID NO: 5412 - protein, 10 aa, Homo sapiens
LVQNCLWTLR

SEQ ID NO: 5413 - protein, 7 aa, Homo sapiens
FCPFAER

SEQ ID NO: 5414 - protein, 15 aa, Homo sapiens
LYSNAYLNDLAGCIK

SEQ ID NO: 5415 - protein, 11 aa, Homo sapiens
LGMLSPEGTCK

SEQ ID NO: 5416 - protein, 11 aa, Homo sapiens
GAALITAVACR

SEQ ID NO: 5417 - protein, 8 aa, Homo sapiens
GYCYVEFK

SEQ ID NO: 5418 - protein, 28 aa, Homo sapiens
ETVKPVEVEEGESVVLPCNPPPSAEPLR

SEQ ID NO: 5419 - protein, 20 aa, Homo sapiens
YLCAGAVDFYNNLENFNVDK

SEQ ID NO: 5420 - protein, 16 aa, Homo sapiens
EFPDVLECTVSHAVEK

SEQ ID NO: 5421 - protein, 14 aa, Homo sapiens
VCPFAGILENGAVR

SEQ ID NO: 5422 - protein, 18 aa, Homo sapiens
CVVTGEDGSESEATVNVK

SEQ ID NO: 5423 - protein, 11 aa, Homo sapiens
CQNALQQVVAR

SEQ ID NO: 5424 - protein, 14 aa, Homo sapiens
ASGCEGEDVVTLLK

SEQ ID NO: 5425 - protein, 14 aa, Homo sapiens
AGDISCNADINPLK

SEQ ID NO: 5426 - protein, 25 aa, Homo sapiens
LTTPTYGDLNHLVSATMSGVTTCLR

SEQ ID NO: 5427 - protein, 17 aa, Homo sapiens
RWLLLCNPGLAELIAEK

SEQ ID NO: 5428 - protein, 8 aa, Homo sapiens
GIFPVLCK

SEQ ID NO: 5429 - protein, 11 aa, Homo sapiens
YLAEVACGDDR

SEQ ID NO: 5430 - protein, 19 aa, Homo sapiens
LVIGQNGILSTPAVSCIIR

SEQ ID NO: 5431 - protein, 20 aa, Homo sapiens
VHSPSGALEECYVTEIDQDK

SEQ ID NO: 5432 - protein, 17 aa, Homo sapiens
YSEEANNLIEECEQAER

SEQ ID NO: 5433 - protein, 19 aa, Homo sapiens
HHITPLLSAVYEGHVSCVK

SEQ ID NO: 5434 - protein, 12 aa, Homo sapiens
CATSKPAFFAEK

SEQ ID NO: 5435 - protein, 17 aa, Homo sapiens
GFNCESKPEAEETCFDK

SEQ ID NO: 5436 - protein, 10 aa, Homo sapiens
IAVAAQNCYK

SEQ ID NO: 5437 - protein, 23 aa, Homo sapiens
ANQQFLVYCEIDGSGNGWTVFQK

SEQ ID NO: 5438 - protein, 15 aa, Homo sapiens
TVSYNGILGPECGTK

SEQ ID NO: 5439 - protein, 23 aa, Homo sapiens
YCGQLQMIQEQISNLEAQITDVR

SEQ ID NO: 5440 - protein, 9 aa, Homo sapiens
AVLCPQPTR

SEQ ID NO: 5441 - protein, 6 aa, Homo sapiens
TNYICR

SEQ ID NO: 5442 - protein, 24 aa, Homo sapiens
VGKDELFALEQSCAQVVLQAANER

SEQ ID NO: 5443 - protein, 12 aa, Homo sapiens
LADFALLCLDGK

SEQ ID NO: 5444 - protein, 15 aa, Homo sapiens
AAQLCGAGLAAIVEK

SEQ ID NO: 5445 - protein, 13 aa, Homo sapiens
LVNLQCEETGVAK

SEQ ID NO: 5446 - protein, 10 aa, Homo sapiens
IPCFLAGDTR

SEQ ID NO: 5447 - protein, 8 aa, Homo sapiens
ITFCTGIR

SEQ ID NO: 5448 - protein, 8 aa, Homo sapiens
ESDCLVCR

SEQ ID NO: 5449 - protein, 15 aa, Homo sapiens
KTPNNPSCNADLINR

SEQ ID NO: 5450 - protein, 16 aa, Homo sapiens
DDMIFEDCGDVPSEPK

SEQ ID NO: 5451 - protein, 10 aa, Homo sapiens
EVCFACVDGK

SEQ ID NO: 5452 - protein, 9 aa, Homo sapiens
LGTQTFCSR

SEQ ID NO: 5453 - protein, 8 aa, Homo sapiens
FCEALDSK

SEQ ID NO: 5454 - protein, 12 aa, Homo sapiens
YTAESSDTLCPR

SEQ ID NO: 5455 - protein, 19 aa, Homo sapiens
NDPHLCDFIETHYLNEQVK

SEQ ID NO: 5456 - protein, 20 aa, Homo sapiens
GTTHCYDGYIHLSGGGLSTK

SEQ ID NO: 5457 - protein, 7 aa, Homo sapiens
SCEVPTR

SEQ ID NO: 5458 - protein, 22 aa, Homo sapiens
NFSAIINPPQACILAIGASEDK

SEQ ID NO: 5459 - protein, 7 aa, Homo sapiens
CFDASFR

SEQ ID NO: 5460 - protein, 12 aa, Homo sapiens
DSNNLCLHFNPR

SEQ ID NO: 5461 - protein, 10 aa, Homo sapiens
ALETCGGDLK

SEQ ID NO: 5462 - protein, 21 aa, Homo sapiens
DGTCTVTYLPTLPGDYSILVK

SEQ ID NO: 5463 - protein, 10 aa, Homo sapiens
IAEVDCTAER

SEQ ID NO: 5464 - protein, 19 aa, Homo sapiens
GVTIIGPATVGGIKPGCFK

SEQ ID NO: 5465 - protein, 12 aa, Homo sapiens
FVASCGFTPDVK

SEQ ID NO: 5466 - protein, 20 aa, Homo sapiens
VQVPNCDEIFYAGTGNLLLR

SEQ ID NO: 5467 - protein, 21 aa, Homo sapiens
GITNLCVIGGDGSLTGANLFR

SEQ ID NO: 5468 - protein, 13 aa, Homo sapiens
LSKPCCYIFPGGR

SEQ ID NO: 5469 - protein, 19 aa, Homo sapiens
VHFVTPVFQPEGAGACYGR

SEQ ID NO: 5470 - protein, 11 aa, Homo sapiens
VCNRYEFLNGR

SEQ ID NO: 5471 - protein, 13 aa, Homo sapiens
ATSITVTGSGSCR

SEQ ID NO: 5472 - protein, 14 aa, Homo sapiens
ACLDTAVENMPSLK

SEQ ID NO: 5473 - protein, 16 aa, Homo sapiens
TPENYPNAGLTMNYCR

SEQ ID NO: 5474 - protein, 23 aa, Homo sapiens
EEPWVDPNSPVLLEDPVLCALAK

SEQ ID NO: 5475 - protein, 27 aa, Homo sapiens
YASICQQNGIVPIVEPEILPDGDHDLK

SEQ ID NO: 5476 - protein, 16 aa, Homo sapiens
NLNEKDYELLCLDGTR

SEQ ID NO: 5477 - protein, 9 aa, Homo sapiens
NGLQSCPIK

SEQ ID NO: 5478 - protein, 17 aa, Homo sapiens
KMEDSVGCLETAEEVKR

SEQ ID NO: 5479 - protein, 17 aa, Homo sapiens
INNAVSNIICSITFGER

SEQ ID NO: 5480 - protein, 10 aa, Homo sapiens
KKPCITYGLR

SEQ ID NO: 5481 - protein, 12 aa, Homo sapiens
LVILANNCPALR

SEQ ID NO: 5482 - protein, 10 aa, Homo sapiens
GDECGLALGR

SEQ ID NO: 5483 - protein, 16 aa, Homo sapiens
GPGLFFILPCTDSFIK

SEQ ID NO: 5484 - protein, 9 aa, Homo sapiens
DCVGPEVEK

SEQ ID NO: 5485 - protein, 18 aa, Homo sapiens
TLLQGSGCLAGIYLEDTK

SEQ ID NO: 5486 - protein, 18 aa, Homo sapiens
NPMDYPVEDAFCKPQLVK

SEQ ID NO: 5487 - protein, 18 aa, Homo sapiens
CDAIVDLIHDIQIVSTTR

SEQ ID NO: 5488 - protein, 13 aa, Homo sapiens
GTFATLSELHCDK

SEQ ID NO: 5489 - protein, 11 aa, Homo sapiens
AAGCDFTNVVK

SEQ ID NO: 5490 - protein, 10 aa, Homo sapiens
IICAQQCSGR

SEQ ID NO: 5491 - protein, 17 aa, Homo sapiens
SFSCSATLEVAGQLIHK

SEQ ID NO: 5492 - protein, 8 aa, Homo sapiens
EMVECFNK

SEQ ID NO: 5493 - protein, 19 aa, Homo sapiens
GPDNCIQCAHYIDGPHCVK

SEQ ID NO: 5494 - protein, 27 aa, Homo sapiens
IVGYFVSGCDPSIMGIGPVPAISGALK

SEQ ID NO: 5495 - protein, 20 aa, Homo sapiens
SVPMSTYLVCFAVHQFDSVK

SEQ ID NO: 5496 - protein, 18 aa, Homo sapiens
VVSGMVNCNDDQGVLLGR

SEQ ID NO: 5497 - protein, 8 aa, Homo sapiens
YQCYCYGR

SEQ ID NO: 5498 - protein, 18 aa, Homo sapiens
CQPSPDEARPLQALLDGR

SEQ ID NO: 5499 - protein, 35 aa, Homo sapiens
LGVHPLSCHGWVLGEHGDSSVPVWSGMNVAGVSLK

SEQ ID NO: 5500 - protein, 15 aa, Homo sapiens
FGAQLQCVTGPQATR

SEQ ID NO: 5501 - protein, 14 aa, Homo sapiens
ICDQWDNLGALTQK

SEQ ID NO: 5502 - protein, 11 aa, Homo sapiens
LICQATGFSPR

SEQ ID NO: 5503 - protein, 9 aa, Homo sapiens
ACGQIFCGK

SEQ ID NO: 5504 - protein, 10 aa, Homo sapiens
STCIYGGAPK

SEQ ID NO: 5505 - protein, 10 aa, Homo sapiens
GHFGPIHCVR

SEQ ID NO: 5506 - protein, 23 aa, Homo sapiens
DTCPPLMLYNPTTYQMDVNPEGK

SEQ ID NO: 5507 - protein, 17 aa, Homo sapiens
CECQDGENQSVYQNLCR

SEQ ID NO: 5508 - protein, 11 aa, Homo sapiens
FACHSASLTVR

SEQ ID NO: 5509 - protein, 21 aa, Homo sapiens
DGTVLCELINALYPEGQAPVK

SEQ ID NO: 5510 - protein, 9 aa, Homo sapiens
NCQFETAQK

SEQ ID NO: 5511 - protein, 18 aa, Homo sapiens
DQDKDQCILITGESGAGK

SEQ ID NO: 5512 - protein, 25 aa, Homo sapiens
VTELQQQPLCTSVNTIYDNAVQGLR

SEQ ID NO: 5513 - protein, 10 aa, Homo sapiens
ENELTYYCCK

SEQ ID NO: 5514 - protein, 9 aa, Homo sapiens
ALLPHVLCK

SEQ ID NO: 5515 - protein, 7 aa, Homo sapiens
IVNLACK

SEQ ID NO: 5516 - protein, 10 aa, Homo sapiens
NGSLICTASK

SEQ ID NO: 5517 - protein, 22 aa, Homo sapiens
ACLISLGYDIGNDPQGEAEFAR

SEQ ID NO: 5518 - protein, 12 aa, Homo sapiens
NDLGHPFCNNLR

SEQ ID NO: 5519 - protein, 21 aa, Homo sapiens
HLANTDVPIPTHYFVVLTSCK

SEQ ID NO: 5520 - protein, 18 aa, Homo sapiens
TDVNKIEEFLEEVLCPPK

SEQ ID NO: 5521 - protein, 10 aa, Homo sapiens
VDATADYICK

SEQ ID NO: 5522 - protein, 15 aa, Homo sapiens
SAVEQLCLAESTRPR

SEQ ID NO: 5523 - protein, 11 aa, Homo sapiens
VCNGIGIGEFK

SEQ ID NO: 5524 - protein, 20 aa, Homo sapiens
FNNWGGSLSLGHPFGATGCR

SEQ ID NO: 5525 - protein, 17 aa, Homo sapiens
NETLGGTCLNVGCIPSK

SEQ ID NO: 5526 - protein, 24 aa, Homo sapiens
ALTPQCGSGEDLYILTGTVPSDYR

SEQ ID NO: 5527 - protein, 22 aa, Homo sapiens
TETGQELECLQDHLDDLVVECR

SEQ ID NO: 5528 - protein, 12 aa, Homo sapiens
YQIDPDACFSAK

SEQ ID NO: 5529 - protein, 15 aa, Homo sapiens
RFGLEGCEVLIPALK

SEQ ID NO: 5530 - protein, 14 aa, Homo sapiens
YVMLPVADQDQCIR

SEQ ID NO: 5531 - protein, 11 aa, Homo sapiens
TCESLGAGGYR

SEQ ID NO: 5532 - protein, 9 aa, Homo sapiens
SSFTVDCSK

SEQ ID NO: 5533 - protein, 17 aa, Homo sapiens
LQCDLQDPIVCLADHPR

SEQ ID NO: 5534 - protein, 18 aa, Homo sapiens
ALEHVDGTHVCQLPEDQK

SEQ ID NO: 5535 - protein, 17 aa, Homo sapiens
KREDCSPADKPYIDEAR

SEQ ID NO: 5536 - protein, 18 aa, Homo sapiens
YKPAVNQIECHPYLTQEK

SEQ ID NO: 5537 - protein, 9 aa, Homo sapiens
ALCADLSPR

SEQ ID NO: 5538 - protein, 13 aa, Homo sapiens
CQHAAEIITDLLR

SEQ ID NO: 5539 - protein, 10 aa, Homo sapiens
LTICPQAENR

SEQ ID NO: 5540 - protein, 16 aa, Homo sapiens
DICEEQVNSLPGSITK

SEQ ID NO: 5541 - protein, 22 aa, Homo sapiens
AVPTGDMEDLPCGLVLSSIGYK

SEQ ID NO: 5542 - protein, 14 aa, Homo sapiens
LEPQIAVANTYACK

SEQ ID NO: 5543 - protein, 8 aa, Homo sapiens
IAFSCPQK

SEQ ID NO: 5544 - protein, 12 aa, Homo sapiens
IKNQADCIPFFR

SEQ ID NO: 5545 - protein, 20 aa, Homo sapiens
VHSPSGAVEECHVSELEPDK

SEQ ID NO: 5546 - protein, 10 aa, Homo sapiens
CEPIIMTVPR

SEQ ID NO: 5547 - protein, 8 aa, Homo sapiens
FVCAPPSR

SEQ ID NO: 5548 - protein, 23 aa, Homo sapiens
NLHNCVNIILLADHGMDQTYCNK

SEQ ID NO: 5549 - protein, 11 aa, Homo sapiens
MYGCDVGPDGR

SEQ ID NO: 5550 - protein, 10 aa, Homo sapiens
NIYYLCAPNR

SEQ ID NO: 5551 - protein, 13 aa, Homo sapiens
QNCELFEQLGEYK

SEQ ID NO: 5552 - protein, 12 aa, Homo sapiens
HELQANCYEEVK

SEQ ID NO: 5553 - protein, 11 aa, Homo sapiens
CLPTACTIQLR

SEQ ID NO: 5554 - protein, 12 aa, Homo sapiens
KVCNGIGIGEFK

SEQ ID NO: 5555 - protein, 15 aa, Homo sapiens
LQHPNVVCLLGVVTK

SEQ ID NO: 5556 - protein, 16 aa, Homo sapiens
FLSQIESDCLALLQVR

SEQ ID NO: 5557 - protein, 15 aa, Homo sapiens
NYCGLPGEYWLGNDK

SEQ ID NO: 5558 - protein, 24 aa, Homo sapiens
YKVEYPIMYSTDPENGHIFNCIQR

SEQ ID NO: 5559 - protein, 14 aa, Homo sapiens
AVQGMLDFDYVCSR

SEQ ID NO: 5560 - protein, 18 aa, Homo sapiens
VRVELLHNPAFCSLATTK

SEQ ID NO: 5561 - protein, 11 aa, Homo sapiens
LVEALCAAGHR

SEQ ID NO: 5562 - protein, 9 aa, Homo sapiens
SGVYCGPLK

SEQ ID NO: 5563 - protein, 11 aa, Homo sapiens
KITIADCGQLE

SEQ ID NO: 5564 - protein, 7 aa, Homo sapiens
LYALCTR

SEQ ID NO: 5565 - protein, 12 aa, Homo sapiens
AYLDGTCVEWLR

SEQ ID NO: 5566 - protein, 17 aa, Homo sapiens
LADYCAGAMFVQQLLSR

SEQ ID NO: 5567 - protein, 7 aa, Homo sapiens
FLLEACK

SEQ ID NO: 5568 - protein, 13 aa, Homo sapiens
VFLDCCNYITELR

SEQ ID NO: 5569 - protein, 8 aa, Homo sapiens
LVPSCDVR

SEQ ID NO: 5570 - protein, 7 aa, Homo sapiens
TIFFCER

SEQ ID NO: 5571 - protein, 11 aa, Homo sapiens
KPVVGQCTIER

SEQ ID NO: 5572 - protein, 22 aa, Homo sapiens
EKTEVEPFENIEVYNLMCDLLR

SEQ ID NO: 5573 - protein, 13 aa, Homo sapiens
CQLEINFNTLQTK

SEQ ID NO: 5574 - protein, 17 aa, Homo sapiens
FLEGTSCIAGVFVDATK

SEQ ID NO: 5575 - protein, 16 aa, Homo sapiens
ALEIPGEELPGVCSAR

SEQ ID NO: 5576 - protein, 13 aa, Homo sapiens
IICDNTGITTVSK

SEQ ID NO: 5577 - protein, 13 aa, Homo sapiens
NCLTNFHGMDLTR

SEQ ID NO: 5578 - protein, 14 aa, Homo sapiens
LCETVMAQILEHLK

SEQ ID NO: 5579 - protein, 14 aa, Homo sapiens
GFCYVEFDEVDSLK

SEQ ID NO: 5580 - protein, 22 aa, Homo sapiens
LCPGGQLPFLLYGTEVHTDTNK

SEQ ID NO: 5581 - protein, 14 aa, Homo sapiens
FGLEGCEVLIPALK

SEQ ID NO: 5582 - protein, 13 aa, Homo sapiens
CLATGPGIASTVK

SEQ ID NO: 5583 - protein, 11 aa, Homo sapiens
SSVVPCELACR

SEQ ID NO: 5584 - protein, 8 aa, Homo sapiens
CVFWDLGR

SEQ ID NO: 5585 - protein, 13 aa, Homo sapiens
LGCQDAFPEVYDK

SEQ ID NO: 5586 - protein, 6 aa, Homo sapiens
FACFER

SEQ ID NO: 5587 - protein, 22 aa, Homo sapiens
VAEPELMGTPDGTCYPPPPVPR

SEQ ID NO: 5588 - protein, 9 aa, Homo sapiens
YSFGATCVK

SEQ ID NO: 5589 - protein, 18 aa, Homo sapiens
CHAGHLNGVYYQGGTYSK

SEQ ID NO: 5590 - protein, 13 aa, Homo sapiens
CEFQDAYVLLSEK

SEQ ID NO: 5591 - protein, 16 aa, Homo sapiens
LLGNVLVCVLAHHFGK

SEQ ID NO: 5592 - protein, 12 aa, Homo sapiens
VVPCLVTPVTGR

SEQ ID NO: 5593 - protein, 12 aa, Homo sapiens
DLFHCVSFTLPR

SEQ ID NO: 5594 - protein, 17 aa, Homo sapiens
ACANPAAGSVILLENLR

SEQ ID NO: 5595 - protein, 12 aa, Homo sapiens
LFACGIGSTANR

SEQ ID NO: 5596 - protein, 9 aa, Homo sapiens
NCIDITGVR

SEQ ID NO: 5597 - protein, 16 aa, Homo sapiens
LLGNVIVCVLAHHFGK

SEQ ID NO: 5598 - protein, 9 aa, Homo sapiens
VCAYGPGLK

SEQ ID NO: 5599 - protein, 14 aa, Homo sapiens
SLHDALCVLAQTVK

SEQ ID NO: 5600 - protein, 8 aa, Homo sapiens
LIQYCHSK

SEQ ID NO: 5601 - protein, 17 aa, Homo sapiens
CVEDPETGLCLLPLTDK

SEQ ID NO: 5602 - protein, 12 aa, Homo sapiens
NYVVTDHGSCVR

SEQ ID NO: 5603 - protein, 10 aa, Homo sapiens
GWPLELLCEK

SEQ ID NO: 5604 - protein, 13 aa, Homo sapiens
AQIMLCGEITHPK

SEQ ID NO: 5605 - protein, 14 aa, Homo sapiens
VADEGSFTCFVSIR

SEQ ID NO: 5606 - protein, 26 aa, Homo sapiens
KGYEVIYLTEPVDEYCIQALPEFDGK

SEQ ID NO: 5607 - protein, 10 aa, Homo sapiens
CPPGTYVSAK

SEQ ID NO: 5608 - protein, 14 aa, Homo sapiens
CVDLVIQELINTVR

SEQ ID NO: 5609 - protein, 8 aa, Homo sapiens
IAVHCTVR

SEQ ID NO: 5610 - protein, 9 aa, Homo sapiens
NCMTDLLAK

SEQ ID NO: 5611 - protein, 27 aa, Homo sapiens
MSASQLEALCPQVINAALALAAKPQSK

SEQ ID NO: 5612 - protein, 8 aa, Homo sapiens
ELVLDNCK

SEQ ID NO: 5613 - protein, 11 aa, Homo sapiens
CQSLQEELDFR

SEQ ID NO: 5614 - protein, 7 aa, Homo sapiens
CTVSLTR

SEQ ID NO: 5615 - protein, 22 aa, Homo sapiens
QSAYCPYSHFPVGAALLTQEGR

SEQ ID NO: 5616 - protein, 6 aa, Homo sapiens
LLLCAR

SEQ ID NO: 5617 - protein, 16 aa, Homo sapiens
SSGGPGAGLCLFPLDK

SEQ ID NO: 5618 - protein, 14 aa, Homo sapiens
LPQPVQPDPVSHCK

SEQ ID NO: 5619 - protein, 10 aa, Homo sapiens
GFPTICYFEK

SEQ ID NO: 5620 - protein, 11 aa, Homo sapiens
CLAPMMSEVIR

SEQ ID NO: 5621 - protein, 14 aa, Homo sapiens
LYAQDADGCPIDIK

SEQ ID NO: 5622 - protein, 8 aa, Homo sapiens
CNSLEEIK

SEQ ID NO: 5623 - protein, 13 aa, Homo sapiens
CASQVGMTAPGTR

SEQ ID NO: 5624 - protein, 25 aa, Homo sapiens
KGGSYSQAASSDSAQGSDVSLTACK

SEQ ID NO: 5625 - protein, 11 aa, Homo sapiens
INISEGNCPER

SEQ ID NO: 5626 - protein, 13 aa, Homo sapiens
TECALLGFVTDLK

SEQ ID NO: 5627 - protein, 15 aa, Homo sapiens
NTIMECQVCGFHEQR

SEQ ID NO: 5628 - protein, 30 aa, Homo sapiens
VGEAGLLSVDCSEAGPGALGLEAVSDSGTK

SEQ ID NO: 5629 - protein, 15 aa, Homo sapiens
SHTLAQCLGFQEFQK

SEQ ID NO: 5630 - protein, 8 aa, Homo sapiens
FCLDNGAK

SEQ ID NO: 5631 - protein, 13 aa, Homo sapiens
VDSTTCLFPVEEK

SEQ ID NO: 5632 - protein, 14 aa, Homo sapiens
FTTDDSICVLGISK

SEQ ID NO: 5633 - protein, 9 aa, Homo sapiens
CLEELLSSR

SEQ ID NO: 5634 - protein, 10 aa, Homo sapiens
LECADLLETR

SEQ ID NO: 5635 - protein, 13 aa, Homo sapiens
GYLGPEQLPDCLK

SEQ ID NO: 5636 - protein, 19 aa, Homo sapiens
TDPHLCDFLETHFLDEEVK

SEQ ID NO: 5637 - protein, 8 aa, Homo sapiens
SNVCTLVR

SEQ ID NO: 5638 - protein, 17 aa, Homo sapiens
TFVPGCQPGEFTLGNIK

SEQ ID NO: 5639 - protein, 17 aa, Homo sapiens
MLSAVSQQVQCIQEALR

SEQ ID NO: 5640 - protein, 21 aa, Homo sapiens
LINYHQEQAVNCLLGNVFYER

SEQ ID NO: 5641 - protein, 19 aa, Homo sapiens
YGDGGSTFQSTTGHCVHMR

SEQ ID NO: 5642 - protein, 17 aa, Homo sapiens
LYNTCAVFGPDGTLLAK

SEQ ID NO: 5643 - protein, 7 aa, Homo sapiens
FPSVCEK

SEQ ID NO: 5644 - protein, 11 aa, Homo sapiens
LVDGVTECSGR

SEQ ID NO: 5645 - protein, 19 aa, Homo sapiens
LIEVANLACSISNNEEGVK

SEQ ID NO: 5646 - protein, 10 aa, Homo sapiens
CGGIVGIQTK

SEQ ID NO: 5647 - protein, 15 aa, Homo sapiens
FGANAILGVSLAVCK

SEQ ID NO: 5648 - protein, 9 aa, Homo sapiens
IPLNGLGCR

SEQ ID NO: 5649 - protein, 10 aa, Homo sapiens
AGCSNIAYPR

SEQ ID NO: 5650 - protein, 14 aa, Homo sapiens
ILALCMGNHELYMR

SEQ ID NO: 5651 - protein, 8 aa, Homo sapiens
QSLLFCPK

SEQ ID NO: 5652 - protein, 11 aa, Homo sapiens
ILAFPCNQFGK

SEQ ID NO: 5653 - protein, 16 aa, Homo sapiens
GDECQLVGPAQPSHWK

SEQ ID NO: 5654 - protein, 11 aa, Homo sapiens
LEDLVCDVVDR

SEQ ID NO: 5655 - protein, 11 aa, Homo sapiens
CDENILWLDYK

SEQ ID NO: 5656 - protein, 12 aa, Homo sapiens
LECSEELGDLVK

SEQ ID NO: 5657 - protein, 25 aa, Homo sapiens
ITYPLGLATLGATVCYPVQSVIIAK

SEQ ID NO: 5658 - protein, 12 aa, Homo sapiens
CVANNQVETLEK

SEQ ID NO: 5659 - protein, 18 aa, Homo sapiens
NPTFMGLALHCIASVGSR

SEQ ID NO: 5660 - protein, 19 aa, Homo sapiens
DMAGLLKPTACTMLVSSLR

SEQ ID NO: 5661 - protein, 11 aa, Homo sapiens
MYGCDLGPDGR

SEQ ID NO: 5662 - protein, 8 aa, Homo sapiens
CPDYIIQK

SEQ ID NO: 5663 - protein, 13 aa, Homo sapiens
ADEASELACPTPK

SEQ ID NO: 5664 - protein, 12 aa, Homo sapiens
RPEEVCGPTQFR

SEQ ID NO: 5665 - protein, 18 aa, Homo sapiens
CSGPGLPLYTLHSSVNDK

SEQ ID NO: 5666 - protein, 11 aa, Homo sapiens
TDLLNVCMNAK

SEQ ID NO: 5667 - protein, 7 aa, Homo sapiens
ITEFCHR

SEQ ID NO: 5668 - protein, 14 aa, Homo sapiens
ARPCIIPENEEIPR

SEQ ID NO: 5669 - protein, 11 aa, Homo sapiens
LLETECPQYIR

SEQ ID NO: 5670 - protein, 13 aa, Homo sapiens
TVLCGTCGQPADK

SEQ ID NO: 5671 - protein, 13 aa, Homo sapiens
QELEEICHDLEAR

SEQ ID NO: 5672 - protein, 14 aa, Homo sapiens
EQLGEFYEALDCLR

SEQ ID NO: 5673 - protein, 18 aa, Homo sapiens
MEENLSEPVHCVSLNEIR

SEQ ID NO: 5674 - protein, 19 aa, Homo sapiens
SCSGVEFSTSGSSNTDTGK

SEQ ID NO: 5675 - protein, 12 aa, Homo sapiens
VTCLSCELNPER

SEQ ID NO: 5676 - protein, 11 aa, Homo sapiens
SETVLTCATGR

SEQ ID NO: 5677 - protein, 9 aa, Homo sapiens
VMPICLPSK

SEQ ID NO: 5678 - protein, 21 aa, Homo sapiens
MPCAEDYLSVVLNQLCVLHEK

SEQ ID NO: 5679 - protein, 17 aa, Homo sapiens
GCITIIGGGDTATCCAK

SEQ ID NO: 5680 - protein, 17 aa, Homo sapiens
ALAQCAPPPAVCAELVR

SEQ ID NO: 5681 - protein, 13 aa, Homo sapiens
SNGLICGGNGVCK

SEQ ID NO: 5682 - protein, 12 aa, Homo sapiens
DLEEDHACIPIK

SEQ ID NO: 5683 - protein, 11 aa, Homo sapiens
VIATFTCSGEK

SEQ ID NO: 5684 - protein, 13 aa, Homo sapiens
FLNDTSLPHSCFR

SEQ ID NO: 5685 - protein, 11 aa, Homo sapiens
MLLASPGACFK

SEQ ID NO: 5686 - protein, 12 aa, Homo sapiens
EGDEVTLICSAR

SEQ ID NO: 5687 - protein, 17 aa, Homo sapiens
MIPCDFLIPVQTQHPIR

SEQ ID NO: 5688 - protein, 14 aa, Homo sapiens
DCGATWVVLGHSER

SEQ ID NO: 5689 - protein, 19 aa, Homo sapiens
CAPGVVGPAEADIDFDIIR

SEQ ID NO: 5690 - protein, 13 aa, Homo sapiens
LFSVPDFVGDACK

SEQ ID NO: 5691 - protein, 15 aa, Homo sapiens
ADRDQYELLCLDNTR

SEQ ID NO: 5692 - protein, 12 aa, Homo sapiens
CEDPTSYMEVAK

SEQ ID NO: 5693 - protein, 8 aa, Homo sapiens
TEAADLCK

SEQ ID NO: 5694 - protein, 9 aa, Homo sapiens
AVVMISCNR

SEQ ID NO: 5695 - protein, 23 aa, Homo sapiens
LVRPEVDVMCTAFHDNEETFLKK

SEQ ID NO: 5696 - protein, 9 aa, Homo sapiens
CLSSLKDER

SEQ ID NO: 5697 - protein, 27 aa, Homo sapiens
AAAAGSGDLPPLGPATLLALCVQHSAR

SEQ ID NO: 5698 - protein, 9 aa, Homo sapiens
YLATCADDR

SEQ ID NO: 5699 - protein, 14 aa, Homo sapiens
CTVFHGAQVEDAFR

SEQ ID NO: 5700 - protein, 20 aa, Homo sapiens
AAQLCAAALAAVLSCLQHSR

SEQ ID NO: 5701 - protein, 19 aa, Homo sapiens
TPAILEASAGAIQNLCAGR

SEQ ID NO: 5702 - protein, 18 aa, Homo sapiens
ACLDYPVTSVLPPASLCK

SEQ ID NO: 5703 - protein, 15 aa, Homo sapiens
SYDYQSVCEPGAAPK

SEQ ID NO: 5704 - protein, 11 aa, Homo sapiens
LLCGGGIAADR

SEQ ID NO: 5705 - protein, 23 aa, Homo sapiens
IPQVTPADSGEYVCHVSNGAGSR

SEQ ID NO: 5706 - protein, 9 aa, Homo sapiens
TVVALCGQR

SEQ ID NO: 5707 - protein, 30 aa, Homo sapiens
MGVEAVIALLEATPDTPACVVSLNGNHAVR

SEQ ID NO: 5708 - protein, 20 aa, Homo sapiens
VPADTEVVCAPPTAYIDFAR

SEQ ID NO: 5709 - protein, 21 aa, Homo sapiens
ALVLIAFAQYLQQCPFEDHVK

SEQ ID NO: 5710 - protein, 19 aa, Homo sapiens
RPHETGGYMLECVCLGNGK

SEQ ID NO: 5711 - protein, 16 aa, Homo sapiens
CLELFTELAEDKENYK

SEQ ID NO: 5712 - protein, 11 aa, Homo sapiens
DIIACGFDINK

SEQ ID NO: 5713 - protein, 13 aa, Homo sapiens
LESDVSAQMEYCR

SEQ ID NO: 5714 - protein, 8 aa, Homo sapiens
VEAIPNCK

SEQ ID NO: 5715 - protein, 15 aa, Homo sapiens
GLYDGPVCEVSVTPK

SEQ ID NO: 5716 - protein, 15 aa, Homo sapiens
CSDSTLLSNLLEEMK

SEQ ID NO: 5717 - protein, 11 aa, Homo sapiens
GAPLVVICQGK

SEQ ID NO: 5718 - protein, 11 aa, Homo sapiens
GCVGEVSVNGK

SEQ ID NO: 5719 - protein, 21 aa, Homo sapiens
TYFSCTSAHTSTGDGTAMITR

SEQ ID NO: 5720 - protein, 8 aa, Homo sapiens
ADLCQLIR

SEQ ID NO: 5721 - protein, 9 aa, Homo sapiens
SSFLVDCSK

SEQ ID NO: 5722 - protein, 16 aa, Homo sapiens
DLRPGDTVTITCSSYR

SEQ ID NO: 5723 - protein, 8 aa, Homo sapiens
GYCDVFMR

SEQ ID NO: 5724 - protein, 16 aa, Homo sapiens
DGDNNLAQQLAVLCGR

SEQ ID NO: 5725 - protein, 9 aa, Homo sapiens
ALPCIVDVR

SEQ ID NO: 5726 - protein, 19 aa, Homo sapiens
KPLVLCGDLNVAHEEIDLR

SEQ ID NO: 5727 - protein, 31 aa, Homo sapiens
VLSSSGSEAAVPSVCFLVPPPNQEAQEAVTR

SEQ ID NO: 5728 - protein, 7 aa, Homo sapiens
CLYDYVK

SEQ ID NO: 5729 - protein, 12 aa, Homo sapiens
CHPQTIAVVQTR

SEQ ID NO: 5730 - protein, 19 aa, Homo sapiens
LGDVGMAELCPGLLHPSSR

SEQ ID NO: 5731 - protein, 16 aa, Homo sapiens
GVLFGVPGAFTPGCSK

SEQ ID NO: 5732 - protein, 10 aa, Homo sapiens
DVIIDLLCYR

SEQ ID NO: 5733 - protein, 15 aa, Homo sapiens
LLGSTIPLCSAQWER

SEQ ID NO: 5734 - protein, 17 aa, Homo sapiens
SQSVRPGADVTFICTAK

SEQ ID NO: 5735 - protein, 13 aa, Homo sapiens
GCDVVVIPAGVPR

SEQ ID NO: 5736 - protein, 11 aa, Homo sapiens
GFEGSFEELCR

SEQ ID NO: 5737 - protein, 14 aa, Homo sapiens
VQELGHGCAALVTK

SEQ ID NO: 5738 - protein, 18 aa, Homo sapiens
EAGDGVFECEYYPVVPGK

SEQ ID NO: 5739 - protein, 8 aa, Homo sapiens
GQFPNLCR

SEQ ID NO: 5740 - protein, 6 aa, Homo sapiens
CIQCTR

SEQ ID NO: 5741 - protein, 8 aa, Homo sapiens
GESLPCVK

SEQ ID NO: 5742 - protein, 19 aa, Homo sapiens
DVLNLVYLCEALNLPEVAR

SEQ ID NO: 5743 - protein, 9 aa, Homo sapiens
ACNLDDICK

SEQ ID NO: 5744 - protein, 8 aa, Homo sapiens
GLPFGCTK

SEQ ID NO: 5745 - protein, 7 aa, Homo sapiens
LTGECLK

SEQ ID NO: 5746 - protein, 13 aa, Homo sapiens
LTGSCSYVLFQNK

SEQ ID NO: 5747 - protein, 22 aa, Homo sapiens
GTFATLSELHCDKLHVDPENFR

SEQ ID NO: 5748 - protein, 7 aa, Homo sapiens
WNCLVAR

SEQ ID NO: 5749 - protein, 26 aa, Homo sapiens
KFPVFNPATEEELCQVEEGDKEDVDK

SEQ ID NO: 5750 - protein, 16 aa, Homo sapiens
NSLCIENSCIAAHDKR

SEQ ID NO: 5751 - protein, 11 aa, Homo sapiens
VCALLSCTSHK

SEQ ID NO: 5752 - protein, 13 aa, Homo sapiens
CHLDTTGTYTQYR

SEQ ID NO: 5753 - protein, 22 aa, Homo sapiens
NVPILYTASQACLQHPDVAAYK

SEQ ID NO: 5754 - protein, 13 aa, Homo sapiens
GVVSDHCYPFSGR

SEQ ID NO: 5755 - protein, 16 aa, Homo sapiens
LEDVALQILLACPVSK

SEQ ID NO: 5756 - protein, 24 aa, Homo sapiens
GIISILDEECLRPGEATDLTFLEK

SEQ ID NO: 5757 - protein, 16 aa, Homo sapiens
AITIANQTNCPLYITK

SEQ ID NO: 5758 - protein, 15 aa, Homo sapiens
HMSEFMECNLNELVK

SEQ ID NO: 5759 - protein, 16 aa, Homo sapiens
SSEHINEGETAMLVCK

SEQ ID NO: 5760 - protein, 27 aa, Homo sapiens
HTGPGILSMANAGPNTNGSQFFICTAK

SEQ ID NO: 5761 - protein, 10 aa, Homo sapiens
WCSWSLSQAR

SEQ ID NO: 5762 - protein, 21 aa, Homo sapiens
HIDCAYVYQNEHEVGEAIQEK

SEQ ID NO: 5763 - protein, 16 aa, Homo sapiens
APSVATVGSICDLNLK

SEQ ID NO: 5764 - protein, 8 aa, Homo sapiens
ALEVEECR

SEQ ID NO: 5765 - protein, 14 aa, Homo sapiens
DYNVYTHSFLCYGK

SEQ ID NO: 5766 - protein, 17 aa, Homo sapiens
TCPKPDDLPFSTVVPLK

SEQ ID NO: 5767 - protein, 7 aa, Homo sapiens
KLLDFCK

SEQ ID NO: 5768 - protein, 8 aa, Homo sapiens
GCQMYLEK

SEQ ID NO: 5769 - protein, 6 aa, Homo sapiens
SLYNCR

SEQ ID NO: 5770 - protein, 29 aa, Homo sapiens
NLTQQLQTTCHTLLSNIQGVPQNIQDQAK

SEQ ID NO: 5771 - protein, 11 aa, Homo sapiens
YQQGDFGYCPR

SEQ ID NO: 5772 - protein, 14 aa, Homo sapiens
CSGVEHFILEVIGR

SEQ ID NO: 5773 - protein, 17 aa, Homo sapiens
VNCETSCVQQPPCFPLK

SEQ ID NO: 5774 - protein, 20 aa, Homo sapiens
IGALQLQLSQLHEQCSSLEK

SEQ ID NO: 5775 - protein, 15 aa, Homo sapiens
SFDVNKPGCEVDDLK

SEQ ID NO: 5776 - protein, 8 aa, Homo sapiens
VVPDSCCK

SEQ ID NO: 5777 - protein, 8 aa, Homo sapiens
LLPLNDCR

SEQ ID NO: 5778 - protein, 20 aa, Homo sapiens
TEVEPFENIEVYNLMCDLLR

SEQ ID NO: 5779 - protein, 15 aa, Homo sapiens
AGCAVTSLLASELTK

SEQ ID NO: 5780 - protein, 9 aa, Homo sapiens
EGKPCIIIK

SEQ ID NO: 5781 - protein, 15 aa, Homo sapiens
EDCSPADKPYIDEAR

SEQ ID NO: 5782 - protein, 23 aa, Homo sapiens
AGESVLVHGASGGVGLAACQIAR

SEQ ID NO: 5783 - protein, 9 aa, Homo sapiens
SCSPELQQK

SEQ ID NO: 5784 - protein, 11 aa, Homo sapiens
YNGQVCGGPGR

SEQ ID NO: 5785 - protein, 13 aa, Homo sapiens
EQEGEYYCTAFNR

SEQ ID NO: 5786 - protein, 14 aa, Homo sapiens
VHACGVNPVETYIR

SEQ ID NO: 5787 - protein, 13 aa, Homo sapiens
TGAVYLCPLTAHK

SEQ ID NO: 5788 - protein, 14 aa, Homo sapiens
HHCPSTPIILVGTK

SEQ ID NO: 5789 - protein, 9 aa, Homo sapiens
ATVMFECDK

SEQ ID NO: 5790 - protein, 17 aa, Homo sapiens
YTCHVQHEGLPEPLTLR

SEQ ID NO: 5791 - protein, 13 aa, Homo sapiens
QVQSLTCEVDALK

SEQ ID NO: 5792 - protein, 12 aa, Homo sapiens
FFSASCVPGADK

SEQ ID NO: 5793 - protein, 10 aa, Homo sapiens
TCAYDSLVIR

SEQ ID NO: 5794 - protein, 11 aa, Homo sapiens
DILPCLDGYLK

SEQ ID NO: 5795 - protein, 10 aa, Homo sapiens
TDDLCLDVSK

SEQ ID NO: 5796 - protein, 16 aa, Homo sapiens
VIPACLPSPNYVVADR

SEQ ID NO: 5797 - protein, 13 aa, Homo sapiens
EYLPIGGLAEFCK

SEQ ID NO: 5798 - protein, 20 aa, Homo sapiens
SLLEAQLLCQSGGTLVTQLR

SEQ ID NO: 5799 - protein, 22 aa, Homo sapiens
IIANALSSEPACLAEIEEDKAR

SEQ ID NO: 5800 - protein, 17 aa, Homo sapiens
RAPSVANVGSHCDLSLK

SEQ ID NO: 5801 - protein, 16 aa, Homo sapiens
DETVSDCSPHIANIGR

SEQ ID NO: 5802 - protein, 21 aa, Homo sapiens
AVTDSINQLITMCTQQAPGQK

SEQ ID NO: 5803 - protein, 19 aa, Homo sapiens
GELSGHFEDLLLAIVNCVR

SEQ ID NO: 5804 - protein, 14 aa, Homo sapiens
FGSCQQGVAATFTK

SEQ ID NO: 5805 - protein, 19 aa, Homo sapiens
QPLSSMCPTIMVGQDGQVR

SEQ ID NO: 5806 - protein, 12 aa, Homo sapiens
SLLPGCQSVISR

SEQ ID NO: 5807 - protein, 9 aa, Homo sapiens
SAMCAFPIK

SEQ ID NO: 5808 - protein, 8 aa, Homo sapiens
CDDLEALK

SEQ ID NO: 5809 - protein, 16 aa, Homo sapiens
AITIAGIPQSIIECVK

SEQ ID NO: 5810 - protein, 9 aa, Homo sapiens
DVIIADCGK

SEQ ID NO: 5811 - protein, 10 aa, Homo sapiens
NVVACESIGR

SEQ ID NO: 5812 - protein, 15 aa, Homo sapiens
IATGHNIIDELPPCK

SEQ ID NO: 5813 - protein, 12 aa, Homo sapiens
IVGPSGAAVPCK

SEQ ID NO: 5814 - protein, 27 aa, Homo sapiens
NMITGTAPLDGCILVVAANDGPMPQTR

SEQ ID NO: 5815 - protein, 14 aa, Homo sapiens
GETVNDCHAEIISR

SEQ ID NO: 5816 - protein, 10 aa, Homo sapiens
GLECLVSILK

SEQ ID NO: 5817 - protein, 13 aa, Homo sapiens
EKPNCLNLQDSCK

SEQ ID NO: 5818 - protein, 18 aa, Homo sapiens
NGCGGEIESPASSFHVLR

SEQ ID NO: 5819 - protein, 22 aa, Homo sapiens
TNCNVAVINVGAPAAGMNAAVR

SEQ ID NO: 5820 - protein, 23 aa, Homo sapiens
CKDDEFTHLYTLIVRPDNTYEVK

SEQ ID NO: 5821 - protein, 9 aa, Homo sapiens
CATITPDEK

SEQ ID NO: 5822 - protein, 13 aa, Homo sapiens
AVIDQCNHDNILR

SEQ ID NO: 5823 - protein, 15 aa, Homo sapiens
DVCTELLPLIKPQGR

SEQ ID NO: 5824 - protein, 14 aa, Homo sapiens
GALVAVVGPVGCGK

SEQ ID NO: 5825 - protein, 12 aa, Homo sapiens
SVACDVGYPALK

SEQ ID NO: 5826 - protein, 18 aa, Homo sapiens
GEETPVIVGSALCALEGR

SEQ ID NO: 5827 - protein, 15 aa, Homo sapiens
LGLDPTQEDCVATHR

SEQ ID NO: 5828 - protein, 6 aa, Homo sapiens
CSLIDK

SEQ ID NO: 5829 - protein, 12 aa, Homo sapiens
QTIVPVCSYEER

SEQ ID NO: 5830 - protein, 20 aa, Homo sapiens
WETQQPECGGILTGPYGSIK

SEQ ID NO: 5831 - protein, 18 aa, Homo sapiens
ATATSCRPCPCPYIDASR

SEQ ID NO: 5832 - protein, 14 aa, Homo sapiens
KVFANPEDCVAFGK

SEQ ID NO: 5833 - protein, 22 aa, Homo sapiens
VVNAPIFHVNSDDPEAVMYVCK

SEQ ID NO: 5834 - protein, 24 aa, Homo sapiens
EVGTPHGIILDSVDAAFICPGSSR

SEQ ID NO: 5835 - protein, 14 aa, Homo sapiens
KQLGAGSIEECAAK

SEQ ID NO: 5836 - protein, 10 aa, Homo sapiens
ALSIGFETCR

SEQ ID NO: 5837 - protein, 25 aa, Homo sapiens
AEGSDVANAVLDGADCIMLSGETAK

SEQ ID NO: 5838 - protein, 16 aa, Homo sapiens
YLEGTSCIAGVLVPAK

SEQ ID NO: 5839 - protein, 13 aa, Homo sapiens
LADFALLCLDGKR

SEQ ID NO: 5840 - protein, 15 aa, Homo sapiens
PGHLQEGFGCVVTNR

SEQ ID NO: 5841 - protein, 11 aa, Homo sapiens
VGSVLQEGCGK

SEQ ID NO: 5842 - protein, 24 aa, Homo sapiens
VVESGEDIVLQCAVNEGSGPITYK

SEQ ID NO: 5843 - protein, 16 aa, Homo sapiens
KDCEVVMMIGLPGAGK

SEQ ID NO: 5844 - protein, 11 aa, Homo sapiens
QYSVAFCNHVR

SEQ ID NO: 5845 - protein, 31 aa, Homo sapiens
IGPALSCGNTVVVKPAEQTPLTALHVASLIK

SEQ ID NO: 5846 - protein, 19 aa, Homo sapiens
RCESCAPGYEGNPIQPGGK

SEQ ID NO: 5847 - protein, 9 aa, Homo sapiens
AHIAQLCEK

SEQ ID NO: 5848 - protein, 22 aa, Homo sapiens
KPDCDDWESGLNAMECALHLEK

SEQ ID NO: 5849 - protein, 23 aa, Homo sapiens
TCLITFKPGAFIPGAPVQPVVLR

SEQ ID NO: 5850 - protein, 14 aa, Homo sapiens
ECGLWLSLGGFHER

SEQ ID NO: 5851 - protein, 14 aa, Homo sapiens
VTSLTACLVDQSLR

SEQ ID NO: 5852 - protein, 24 aa, Homo sapiens
VHSPSGAVEECHVSELEPDKYAVR

SEQ ID NO: 5853 - protein, 18 aa, Homo sapiens
VLFICTANVTDTIPEPLR

SEQ ID NO: 5854 - protein, 22 aa, Homo sapiens
AQEACGPLEMDSALSVVQNLEK

SEQ ID NO: 5855 - protein, 19 aa, Homo sapiens
EILDEAYVMASVDNPHVCR

SEQ ID NO: 5856 - protein, 21 aa, Homo sapiens
DDVFLSVPCILGQNGISDLVK

SEQ ID NO: 5857 - protein, 15 aa, Homo sapiens
HLCQQLQAEQAAAEK

SEQ ID NO: 5858 - protein, 8 aa, Homo sapiens
ICEEAFAR

SEQ ID NO: 5859 - protein, 13 aa, Homo sapiens
SSLQSQCLNEVLK

SEQ ID NO: 5860 - protein, 11 aa, Homo sapiens
FCECDNFNCDR

SEQ ID NO: 5861 - protein, 12 aa, Homo sapiens
LFQECCPHSTDR

SEQ ID NO: 5862 - protein, 13 aa, Homo sapiens
YGALVICETSEQK

SEQ ID NO: 5863 - protein, 11 aa, Homo sapiens
GCPPDDIENPR

SEQ ID NO: 5864 - protein, 7 aa, Homo sapiens
CGLVIGR

SEQ ID NO: 5865 - protein, 10 aa, Homo sapiens
EGDTVQLLCR

SEQ ID NO: 5866 - protein, 17 aa, Homo sapiens
CQFTLKPISDSVGVFLR

SEQ ID NO: 5867 - protein, 19 aa, Homo sapiens
NAEVVAGTGEQCLPFDEAR

SEQ ID NO: 5868 - protein, 12 aa, Homo sapiens
CPVDLSTATCEK

SEQ ID NO: 5869 - protein, 12 aa, Homo sapiens
LPADTCLLEFAR

SEQ ID NO: 5870 - protein, 21 aa, Homo sapiens
TNTNVNCPIECFMPLDVQADR

SEQ ID NO: 5871 - protein, 33 aa, Homo sapiens
TYSHLNIAGLVGSIDNDFCGTDMTIGTDSALHR

SEQ ID NO: 5872 - protein, 9 aa, Homo sapiens
TPCEEILVK

SEQ ID NO: 5873 - protein, 14 aa, Homo sapiens
YNCEYSGPPKPLPK

SEQ ID NO: 5874 - protein, 15 aa, Homo sapiens
VTATECIQEQSFVIR

SEQ ID NO: 5875 - protein, 11 aa, Homo sapiens
DGLGFCALIHR

SEQ ID NO: 5876 - protein, 11 aa, Homo sapiens
EATVPCSATGR

SEQ ID NO: 5877 - protein, 18 aa, Homo sapiens
FCGLPQPETVGQLGTVLR

SEQ ID NO: 5878 - protein, 11 aa, Homo sapiens
CLAENSLGSAR

SEQ ID NO: 5879 - protein, 9 aa, Homo sapiens
ALAIEEFCK

SEQ ID NO: 5880 - protein, 10 aa, Homo sapiens
CGIAVAPVSR

SEQ ID NO: 5881 - protein, 19 aa, Homo sapiens
FCPAGVYEFVPVEQGDGFR

SEQ ID NO: 5882 - protein, 8 aa, Homo sapiens
LIQYCQSK

SEQ ID NO: 5883 - protein, 17 aa, Homo sapiens
AQVFHICGPEDVCEAYR

SEQ ID NO: 5884 - protein, 12 aa, Homo sapiens
LFPNCVPSFGFR

SEQ ID NO: 5885 - protein, 8 aa, Homo sapiens
FLTVLCSR

SEQ ID NO: 5886 - protein, 14 aa, Homo sapiens
ECVDKCNLLEGEPR

SEQ ID NO: 5887 - protein, 24 aa, Homo sapiens
FIQENIFGICPHMTEDNKDLIQGK

SEQ ID NO: 5888 - protein, 16 aa, Homo sapiens
SGCIVNNLAEFTVDPK

SEQ ID NO: 5889 - protein, 24 aa, Homo sapiens
LATDKNDPHLCDFIETHYLNEQVK

SEQ ID NO: 5890 - protein, 7 aa, Homo sapiens
LDVLCTK

SEQ ID NO: 5891 - protein, 16 aa, Homo sapiens
SNLCALCIGDEQGENK

SEQ ID NO: 5892 - protein, 7 aa, Homo sapiens
FDAYCFK

SEQ ID NO: 5893 - protein, 6 aa, Homo sapiens
FVNCVR

SEQ ID NO: 5894 - protein, 22 aa, Homo sapiens
TPQICVVGSGPAGFYTAQHLLK

SEQ ID NO: 5895 - protein, 13 aa, Homo sapiens
NTGIICTIGPASR

SEQ ID NO: 5896 - protein, 21 aa, Homo sapiens
LLQDEFPGIPSPLDAAVECHR

SEQ ID NO: 5897 - protein, 10 aa, Homo sapiens
SLGFCDTTNK

SEQ ID NO: 5898 - protein, 9 aa, Homo sapiens
TSGFLCNDR

SEQ ID NO: 5899 - protein, 15 aa, Homo sapiens
CITDPQTGLCLLPLK

SEQ ID NO: 5900 - protein, 9 aa, Homo sapiens
GFSIPECQK

SEQ ID NO: 5901 - protein, 14 aa, Homo sapiens
LSCAPPPPIHAINR

SEQ ID NO: 5902 - protein, 9 aa, Homo sapiens
CLPGFAGER

SEQ ID NO: 5903 - protein, 21 aa, Homo sapiens
TLFTGNLEHLECVTLDIEEQK

SEQ ID NO: 5904 - protein, 9 aa, Homo sapiens
AFDICPLVK

SEQ ID NO: 5905 - protein, 10 aa, Homo sapiens
CDLELETNGR

SEQ ID NO: 5906 - protein, 17 aa, Homo sapiens
EIVHIQAGQCGNQIGAK

SEQ ID NO: 5907 - protein, 7 aa, Homo sapiens
DLAAFCK

SEQ ID NO: 5908 - protein, 20 aa, Homo sapiens
NFQMASITSPSLVVECGGER

SEQ ID NO: 5909 - protein, 15 aa, Homo sapiens
TIAECLADELINAAK

SEQ ID NO: 5910 - protein, 9 aa, Homo sapiens
TGYSFVNCK

SEQ ID NO: 5911 - protein, 16 aa, Homo sapiens
VELLHNPAFCSLATTK

SEQ ID NO: 5912 - protein, 15 aa, Homo sapiens
HYAHTDCPGHADYVK

SEQ ID NO: 5913 - protein, 15 aa, Homo sapiens
CPLLKPWALTFSYGR

SEQ ID NO: 5914 - protein, 9 aa, Homo sapiens
VGSDQCLLR

SEQ ID NO: 5915 - protein, 15 aa, Homo sapiens
DVVICPDASLEDAKK

SEQ ID NO: 5916 - protein, 8 aa, Homo sapiens
GPPVSCLK

SEQ ID NO: 5917 - protein, 6 aa, Homo sapiens
FLMECR

SEQ ID NO: 5918 - protein, 9 aa, Homo sapiens
GETAYLPCK

SEQ ID NO: 5919 - protein, 16 aa, Homo sapiens
TLELNVLVPPAPPSCR

SEQ ID NO: 5920 - protein, 11 aa, Homo sapiens
ALANSLACQGK

SEQ ID NO: 5921 - protein, 14 aa, Homo sapiens
CVVTFLQSEDGSGK

SEQ ID NO: 5922 - protein, 25 aa, Homo sapiens
LEGDLTGPSVGVEVPDVELECPDAK

SEQ ID NO: 5923 - protein, 24 aa, Homo sapiens
VHSPSGALEECYVTEIDQDKYAVR

SEQ ID NO: 5924 - protein, 13 aa, Homo sapiens
VCVETVESGAMTK

SEQ ID NO: 5925 - protein, 7 aa, Homo sapiens
NITEYCR

SEQ ID NO: 5926 - protein, 7 aa, Homo sapiens
YFECQAK

SEQ ID NO: 5927 - protein, 13 aa, Homo sapiens
VVWCAVGEQELRK

SEQ ID NO: 5928 - protein, 13 aa, Homo sapiens
AELFTQSCADLDK

SEQ ID NO: 5929 - protein, 17 aa, Homo sapiens
CRPDQLTGLSLLPLSEK

SEQ ID NO: 5930 - protein, 8 aa, Homo sapiens
LSVAGNCR

SEQ ID NO: 5931 - protein, 10 aa, Homo sapiens
ASLLSAPPCR

SEQ ID NO: 5932 - protein, 14 aa, Homo sapiens
GMDQGLLGMCPGER

SEQ ID NO: 5933 - protein, 17 aa, Homo sapiens
HTWSNNLAVLECLQDVR

SEQ ID NO: 5934 - protein, 11 aa, Homo sapiens
LPLMECVQMTK

SEQ ID NO: 5935 - protein, 14 aa, Homo sapiens
DLYSGLIGPLIVCR

SEQ ID NO: 5936 - protein, 9 aa, Homo sapiens
FLPGGTLCR

SEQ ID NO: 5937 - protein, 30 aa, Homo sapiens
ALGALVDSCAPGLCPDWDSWDASKPVTNAR

SEQ ID NO: 5938 - protein, 14 aa, Homo sapiens
FGVTDFPSCYLLFR

SEQ ID NO: 5939 - protein, 13 aa, Homo sapiens
MDGTYACSYTPVK

SEQ ID NO: 5940 - protein, 12 aa, Homo sapiens
YRDCLTESNLIK

SEQ ID NO: 5941 - protein, 19 aa, Homo sapiens
ELEAVCQDVLSLLDNYLIK

SEQ ID NO: 5942 - protein, 11 aa, Homo sapiens
LLLICDVALGK

SEQ ID NO: 5943 - protein, 15 aa, Homo sapiens
WAELLPLLQQCQVVR

SEQ ID NO: 5944 - protein, 27 aa, Homo sapiens
QAGVCFGDSGSPLVCNGLIHGIASFVR

SEQ ID NO: 5945 - protein, 10 aa, Homo sapiens
EGVVECSFVK

SEQ ID NO: 5946 - protein, 15 aa, Homo sapiens
YPLLLDVYAGPCSQK

SEQ ID NO: 5947 - protein, 10 aa, Homo sapiens
SLESCLLDLR

SEQ ID NO: 5948 - protein, 8 aa, Homo sapiens
LLEACIFK

SEQ ID NO: 5949 - protein, 12 aa, Homo sapiens
MSFTYQIADCNR

SEQ ID NO: 5950 - protein, 11 aa, Homo sapiens
ALLGYADNQCK

SEQ ID NO: 5951 - protein, 12 aa, Homo sapiens
SICTTVLELLDK

SEQ ID NO: 5952 - protein, 10 aa, Homo sapiens
NPIMSQCFDR

SEQ ID NO: 5953 - protein, 12 aa, Homo sapiens
AYLEGLCVESLR

SEQ ID NO: 5954 - protein, 14 aa, Homo sapiens
HMAAASAECQNYAK

SEQ ID NO: 5955 - protein, 22 aa, Homo sapiens
SLFTDLEAENDVLHCVAFAVPK

SEQ ID NO: 5956 - protein, 7 aa, Homo sapiens
DCTFITK

SEQ ID NO: 5957 - protein, 8 aa, Homo sapiens
CESAFLSK

SEQ ID NO: 5958 - protein, 22 aa, Homo sapiens
SGETEDTFIADLVVGLCTGQIK

SEQ ID NO: 5959 - protein, 23 aa, Homo sapiens
ALNVEPDGTGLTCSLAPNIISQL

SEQ ID NO: 5960 - protein, 26 aa, Homo sapiens
LQVEPAVDTSGVQCYGPGIEGQGVFR

SEQ ID NO: 5961 - protein, 10 aa, Homo sapiens
LPCEMDFSGK

SEQ ID NO: 5962 - protein, 10 aa, Homo sapiens
WLVGEMHCQK

SEQ ID NO: 5963 - protein, 11 aa, Homo sapiens
CIESLIAVFQK

SEQ ID NO: 5964 - protein, 11 aa, Homo sapiens
TELLNVCMNAK

SEQ ID NO: 5965 - protein, 24 aa, Homo sapiens
ATFHTPFSHLGQSPEGCSSYTFPK

SEQ ID NO: 5966 - protein, 15 aa, Homo sapiens
ALASECAQHLSLPLR

SEQ ID NO: 5967 - protein, 14 aa, Homo sapiens
IECDDKGDGSCDVR

SEQ ID NO: 5968 - protein, 18 aa, Homo sapiens
ELLNPVVEFVSHPSTTCR

SEQ ID NO: 5969 - protein, 9 aa, Homo sapiens
CNLLEGEPR

SEQ ID NO: 5970 - protein, 8 aa, Homo sapiens
VQCLTDIK

SEQ ID NO: 5971 - protein, 20 aa, Homo sapiens
EQSGDYECSASNDVAAPVVR

SEQ ID NO: 5972 - protein, 40 aa, Homo sapiens
DLEIERPMPGTHTVTLQCPALLVVGDSSPAVDAVVECNSK

SEQ ID NO: 5973 - protein, 10 aa, Homo sapiens
AVLFCLSEDK

SEQ ID NO: 5974 - protein, 12 aa, Homo sapiens
CGLVPVLAENYK

SEQ ID NO: 5975 - protein, 13 aa, Homo sapiens
LADFFTNCQPESR

SEQ ID NO: 5976 - protein, 10 aa, Homo sapiens
GLISSDGFCR

SEQ ID NO: 5977 - protein, 13 aa, Homo sapiens
VIQCFAETGQVQK

SEQ ID NO: 5978 - protein, 13 aa, Homo sapiens
EFLEDTCVQYVQK

SEQ ID NO: 5979 - protein, 6 aa, Homo sapiens
LLDFCK

SEQ ID NO: 5980 - protein, 11 aa, Homo sapiens
CIQSLIAVFQK

SEQ ID NO: 5981 - protein, 10 aa, Homo sapiens
LVCDLITSTK

SEQ ID NO: 5982 - protein, 14 aa, Homo sapiens
ELCQGLGQPGSVLR

SEQ ID NO: 5983 - protein, 11 aa, Homo sapiens
TCLLISYTTNK

SEQ ID NO: 5984 - protein, 21 aa, Homo sapiens
VGADNHVLPLDCVTLQTFLAK

SEQ ID NO: 5985 - protein, 9 aa, Homo sapiens
DYLLCDYNR

SEQ ID NO: 5986 - protein, 14 aa, Homo sapiens
CSTSPLLEACEFLR

SEQ ID NO: 5987 - protein, 12 aa, Homo sapiens
YHTINGHNCEVK

SEQ ID NO: 5988 - protein, 15 aa, Homo sapiens
SASLCAATLAAVLQR

SEQ ID NO: 5989 - protein, 10 aa, Homo sapiens
VGFEGATCDR

SEQ ID NO: 5990 - protein, 7 aa, Homo sapiens
YIEACAR

SEQ ID NO: 5991 - protein, 12 aa, Homo sapiens
AYLEGTCVDGLR

SEQ ID NO: 5992 - protein, 12 aa, Homo sapiens
LESCGVTSDNCR

SEQ ID NO: 5993 - protein, 14 aa, Homo sapiens
TITLQPGSPCNDFR

SEQ ID NO: 5994 - protein, 8 aa, Homo sapiens
GCAVVEFK

SEQ ID NO: 5995 - protein, 16 aa, Homo sapiens
CESISGTLPISYQLLK

SEQ ID NO: 5996 - protein, 16 aa, Homo sapiens
LQFHDVAGDIFHQQCK

SEQ ID NO: 5997 - protein, 10 aa, Homo sapiens
CLFQSPLFAK

SEQ ID NO: 5998 - protein, 16 aa, Homo sapiens
VQVQDNEGCPVEALVK

SEQ ID NO: 5999 - protein, 20 aa, Homo sapiens
LAGANPAVITCDELLLGHEK

SEQ ID NO: 6000 - protein, 13 aa, Homo sapiens
TIVYLDGSSQSCR

SEQ ID NO: 6001 - protein, 9 aa, Homo sapiens
CAPGVGLVR

SEQ ID NO: 6002 - protein, 14 aa, Homo sapiens
IKGCTDNLTLTVAR

SEQ ID NO: 6003 - protein, 13 aa, Homo sapiens
VFNVFCLYGNVEK

SEQ ID NO: 6004 - protein, 8 aa, Homo sapiens
TQVCGILR

SEQ ID NO: 6005 - protein, 13 aa, Homo sapiens
ELPDSVPQECTVR

SEQ ID NO: 6006 - protein, 15 aa, Homo sapiens
DLSHIGDAVVISCAK

SEQ ID NO: 6007 - protein, 22 aa, Homo sapiens
NESCSENYTTDFIYQLYSEEGK

SEQ ID NO: 6008 - protein, 13 aa, Homo sapiens
SEGTYCCGPVPVR

SEQ ID NO: 6009 - protein, 16 aa, Homo sapiens
GLGTDEDSLIEIICSR

SEQ ID NO: 6010 - protein, 9 aa, Homo sapiens
SSLTNCLFR

SEQ ID NO: 6011 - protein, 16 aa, Homo sapiens
GAGTDEGCLIEILASR

SEQ ID NO: 6012 - protein, 7 aa, Homo sapiens
CLGIPTR

SEQ ID NO: 6013 - protein, 10 aa, Homo sapiens
CELIKESEVK

SEQ ID NO: 6014 - protein, 7 aa, Homo sapiens
CNLLAEK

SEQ ID NO: 6015 - protein, 12 aa, Homo sapiens
LEICNLTPDALK

SEQ ID NO: 6016 - protein, 14 aa, Homo sapiens
IVSCGNAIIAELLR

SEQ ID NO: 6017 - protein, 17 aa, Homo sapiens
NGSDCPDKFCLFQSETK

SEQ ID NO: 6018 - protein, 20 aa, Homo sapiens
SVGSQWASPENPCLINECVR

SEQ ID NO: 6019 - protein, 8 aa, Homo sapiens
VCVLAANR

SEQ ID NO: 6020 - protein, 8 aa, Homo sapiens
FNAVLCSR

SEQ ID NO: 6021 - protein, 11 aa, Homo sapiens
LPLVTPHTQCR

SEQ ID NO: 6022 - protein, 15 aa, Homo sapiens
DAFCVFEQNQGLPLR

SEQ ID NO: 6023 - protein, 11 aa, Homo sapiens
VVAACAMPVMK

SEQ ID NO: 6024 - protein, 10 aa, Homo sapiens
ALLLLCGEDD

SEQ ID NO: 6025 - protein, 16 aa, Homo sapiens
SVTDVIIAPLCTSVGR

SEQ ID NO: 6026 - protein, 28 aa, Homo sapiens
CPEALFQPSFLGMESCGIHETTFNSIMK

SEQ ID NO: 6027 - protein, 7 aa, Homo sapiens
CQYVTEK

SEQ ID NO: 6028 - protein, 16 aa, Homo sapiens
KSPQELLCGASLISDR

SEQ ID NO: 6029 - protein, 18 aa, Homo sapiens
GTCQCSVSLPDTTFPVDR

SEQ ID NO: 6030 - protein, 14 aa, Homo sapiens
DVVICPDASLEDAK

SEQ ID NO: 6031 - protein, 20 aa, Homo sapiens
WVDPNSPVLLEDPVLCALAK

SEQ ID NO: 6032 - protein, 9 aa, Homo sapiens
GCVITISGR

SEQ ID NO: 6033 - protein, 15 aa, Homo sapiens
MEDSVGCLETAEEVK

SEQ ID NO: 6034 - protein, 13 aa, Homo sapiens
GYQPCDPQVIQDR

SEQ ID NO: 6035 - protein, 12 aa, Homo sapiens
LSTLCPSAVLQR

SEQ ID NO: 6036 - protein, 7 aa, Homo sapiens
CYVYQAR

SEQ ID NO: 6037 - protein, 30 aa, Homo sapiens
AAAYNLVQHGITNLCVIGGDGSLTGANIFR

SEQ ID NO: 6038 - protein, 13 aa, Homo sapiens
LSCFAQTVSPAEK

SEQ ID NO: 6039 - protein, 18 aa, Homo sapiens
FCTTFSVPPLQTTGPFAR

SEQ ID NO: 6040 - protein, 16 aa, Homo sapiens
WLLLCNPGLAELIAEK

SEQ ID NO: 6041 - protein, 11 aa, Homo sapiens
ATPFIECNGGR

SEQ ID NO: 6042 - protein, 11 aa, Homo sapiens
LTECLETILNK

SEQ ID NO: 6043 - protein, 9 aa, Homo sapiens
DIPDYLCGK

SEQ ID NO: 6044 - protein, 22 aa, Homo sapiens
GIFPVLCKDPVQEAWAEDVDLR
